(12) United States Patent
Marasco

(10) Patent No.: US 12,195,514 B2
(45) Date of Patent: *Jan. 14, 2025

(54) CHIMERIC ANTIGEN RECEPTORS AND METHODS OF USE THEREOF

(71) Applicant: Dana-Farber Cancer Institute, Inc., Boston, MA (US)

(72) Inventor: Wayne A. Marasco, Wellsley, MA (US)

(73) Assignee: Dana-Farber Cancer Institute, Inc., Boston, MA (US)

( * ) Notice: Subject to any disclaimer, the term of this patent is extended or adjusted under 35 U.S.C. 154(b) by 421 days.

This patent is subject to a terminal disclaimer.

(21) Appl. No.: 16/986,913

(22) Filed: Aug. 6, 2020

(65) Prior Publication Data

US 2021/0061877 A1 Mar. 4, 2021

Related U.S. Application Data

(63) Continuation of application No. 15/537,779, filed as application No. PCT/US2015/067225 on Dec. 21, 2015, now abandoned.

(60) Provisional application No. 62/252,083, filed on Nov. 6, 2015, provisional application No. 62/094,625, filed on Dec. 19, 2014.

(51) Int. Cl.
| | | |
|---|---|---|
| C07K 14/725 | (2006.01) | |
| C07K 14/705 | (2006.01) | |
| C07K 14/735 | (2006.01) | |
| C07K 19/00 | (2006.01) | |

(52) U.S. Cl.
CPC ........ *C07K 14/7051* (2013.01); *C07K 14/705* (2013.01); *C07K 14/70521* (2013.01); *C07K 14/70535* (2013.01); *C07K 14/70578* (2013.01); *C07K 19/00* (2013.01); *C07K 2319/02* (2013.01); *C07K 2319/03* (2013.01)

(58) Field of Classification Search
CPC .................................................. C07K 14/7051
See application file for complete search history.

(56) References Cited

U.S. PATENT DOCUMENTS

| | | | |
|---|---|---|---|
| 4,683,202 | A | 7/1987 | Mullis |
| 4,797,368 | A | 1/1989 | Carter et al. |
| 5,139,941 | A | 8/1992 | Muzyczka et al. |
| 5,928,906 | A | 7/1999 | Koester et al. |
| 5,994,136 | A | 11/1999 | Naldini et al. |
| 6,013,516 | A | 1/2000 | Verma et al. |
| 2021/0221906 | A1* | 7/2021 | Marasco ................ C07K 16/40 |

FOREIGN PATENT DOCUMENTS

| | | |
|---|---|---|
| WO | 2005/044996 | 5/2005 |
| WO | 2005/060520 | 7/2005 |
| WO | 2006/089141 | 8/2006 |
| WO | 2007/065027 | 6/2007 |
| WO | 2009/079259 | 6/2009 |
| WO | 2009/086514 | 7/2009 |
| WO | 2011/153380 | 12/2011 |
| WO | 2012/099973 | 7/2012 |
| WO | 2013/0123061 | 8/2013 |
| WO | 2013/0154760 | 10/2013 |
| WO | 2013/166500 | 11/2013 |
| WO | 2014/0011988 | 1/2014 |
| WO | 2014/055897 | 4/2014 |
| WO | 2014/134165 | 9/2014 |
| WO | 2014/144061 | 9/2014 |
| WO | 2015/143194 | 9/2015 |
| WO | 2015/164865 | 10/2015 |
| WO | 2016/054638 | 4/2016 |
| WO | 2016/057488 | 4/2016 |

OTHER PUBLICATIONS

Donahue et al. Journal for Immuno Therapy of Cancer 5:20 DOI 10.1186/s40425-017-0220-y (Year: 2017).*
Wilkie S, Picco G, Foster J, Davies D M, Julien S, Cooper L et al. Retargeting of human T cells to tumor-associated MUC1: the evolution of a chimeric antigen receptor. J Immunol 2008; 180(7): 4901-9.
Written Opinion, WO2016100985, Jul. 4, 2016.
Kiao-Song Zhong et al, "Chimeric Antigen Receptors Combining 4-1BB and CD28 Signaling Domains Augment PI3kinase/AKT/Bcl-XL Activation and CD8+ T Cell-mediated Tumor Eradication", Molecular Therapy, vol. 18, No. 2, Feb. 1, 2010 (Feb. 1, 2010), p. 413-420,.
Xiao-Song Zhong et al, "Chimeric Antigen Receptors Combining 4-1BB and CD28 Signaling Domains Augment PI3kinase/AKT/Bcl-XL Activation and CD8+ T Cell-mediated Tumor Eradication", Molecular Therapy, vol. 18, No. 2, Feb. 1, 2010 (Feb. 1, 2010), p. 413-420.
Xu C, Lo A, Yammanuru A, Tallarico A S, Brady K, Murakami A et al. Unique biological properties of catalytic domain directed human anti-CAIX antibodies discovered through phage-display technology. PloS one 2010; 5(3): e9625.
Zavada J, Zavadova Z, Zatovicova M, Hyrsl L, Kawaciuk I. Soluble form of carbonic anhydrase IX (CA IX) in the serum and urine of renal carcinoma patients. Br J Cancer 2003; 89(6): 1067-71.
Zeytin H, Reali E, Zaharoff DA, Rogers CJ, Schlom J, Greiner J W. Targeted delivery of murine IFN-gamma using a recombinant fowlpox virus: N K cell recruitment to regional lymph nodes and priming of tumor-specific host immunity. Journal of interferon & cytokine research: the official journal of the International Society for Interferon and Cytokine Research 2008; 28(2): 73-87.
Zhong, Xiao-Song, et al. "Chimeric antigen receptors combining 4-1BB and CD28 signaling domains augment PI3kinase/AKT/Bcl-XL activation and CD8+ T cell-mediated tumor eradication." Molecular therapy 18.2 (2010): 413-420.

(Continued)

Primary Examiner — Jessica H Roark
(74) Attorney, Agent, or Firm — Baker Donelson

(57) ABSTRACT

The present invention provides chimeric antigen receptors, cells expressing same and methods of using same for treatment various disorders such as cancer.

12 Claims, 49 Drawing Sheets

Specification includes a Sequence Listing.

(56) References Cited

OTHER PUBLICATIONS

KakaAS, ShafferD R, HartmaierR, Leen AM, Lu A, Bear A, et al. Genetic modification of T cells with IL-21 enhances antigen presentation and generation of central memory tumor-specific cytotoxic T-lymphocytes. Journal of Immunotherapy. 2009; 32:726-36.

Kakarla S, Gottschalk S. CART cells for solid tumors: armed and ready to go? Cancer journal. 2014; 20:151-5.

Kalas M, Levine B L, Porter D L, Katz S, Grupp S A, Bagg A et al. T cells with chimeric antigen receptors have potent antitumor effects and can establish memory in patients with advanced leukemia. Science translational medicine 2011; 3(95): 95ra73.

Kershaw M H, Westwood J A, Parker L L, Wang G, Eshhar Z, Mavroukakis SA et al. A phase I study on adoptive immunotherapy using gene-modified T cells for ovarian cancer. Clin Cancer Res 2006; 12(20 Pt 1): 6106-15.

Lamers CH, Sleijfer S, van Steenbergen S, van Elzakker P, van Krimpen B, Groot C et al. Treatment of metastatic renal cell carcinoma with CAIX CAR-engineered T cells: clinical evaluation and management of on-target toxicity. Molecular therapy: the journal of the American Society of Gene Therapy 2013; 21(4): 904-12.

Lamers CH, Willemsen R, van Elzakker P, van Steenbergen-Langeveld S, Broertjes M, OosterwijkWakka J et al. Immune responses to transgene and retroviral vector in patients treated with ex vivo-engineered T cells. Blood 2011; 117(1): 72-82.

Lancaster J A, Harris A L, Davidson S E, Logue J P, Hunter R D, Wycoff C C et al. Carbonic anhydrase (CA IX) expression, a potential new intrinsic marker of hypoxia: correlations with tumor oxygen measurements and prognosis in locally advanced carcinoma of the cervix. Cancer research 2001; 61(17): 6394-9.

Laughlin et al. Latent infection of KB cells with adeno-associated virus type 2. J Virol. 1986; 8(10): 515-524.

Lebkowski et al. Adeno-Associated Virus: a Vector System for Efficient Introduction and Integration of DNA into a Variety of Mammalian Cell Types. Mol and Cell Biol. 1988; 8(10): 3988-3996.

Li Y, Bleakley M, Yee C. IL-21 influences the frequency, phenotype, and affinity of the antigen-specific CDS T cell response. Journal of immunology. 2005; 175:2261-9.

Liao S Y, Aurelio O N, Jan K, Zavada J, Stanbridge E J. Identification of the MN/CA9 protein as a reliable diagnostic biomarker of clear cell carcinoma of the kidney. Cancer research 1997; 57(14): 2827-31.

Liao S Y, Brewer C, Zavada J, Pastorek J, Pastorekova S, Manetta A et al. Identification of the MN antigen as a diagnostic biomarker of cervical intraepithelial squamous and glandular neoplasia and cervical carcinomas. Am J Pathol 1994; 145(3): 598-609.

Lo A S, Ma Q, Liu D L, Junghans R P. Anti-GD3 chimeric sFv-CD28/T-cell receptor zeta designer T cells for treatment of metastatic melanoma and other neuroectodermal tumors. Clin Cancer Res 2010; 16(10): 2769-80.

Lo A S, Xu C, Murakami A, Marasco WA. Regression of established renal cell carcinoma in nude mice using lentivirus-transduced human T-cells expressing a human anti-CAIX chimeric antigen receptor. Molecular Therapy—Oncolytics. 2014; 1:1-12.

Lo, Agnes Shuk-Yee, et al. "Regression of established renal cell carcinoma in nude mice using lentivirus-transduced human T cells expressing a human anti-CAIX chimeric antigen receptor." Molecular Therapy—Oncolytics 1 (2014).

Long AH, Haso WM, Shern J F, Wanhainen K M, Murgai M, Ingaramo M, et al. 4-IBB costimulation ameliorates T cell exhaustion induced by tonic signaling of chimeric antigen receptors. Nature medicine. 2015; 21:581-90.

Loskog A, Giandomenico V, Rossig C, Pule M, Dotti G, Brenner M K. Addition of the CD28 signaling domain to chimeric T-cell receptors enhances chimeric T-cell resistance to T regulatory cells. Leukemia 2006; 20(10): 1819-28.

Maher J, Brentjens R J, Gunset G, Riviere I, Sadelain M. Human T-lymphocyte cytotoxicity and proliferation directed by a single chimeric TCRzeta/CD28 receptor. Nat Biotechnol 2002; 20(1): 70-5.

Mansour et al. Disruption of the proto-oncogene int-2 in mouse embryo-derived stem cells: a general strategy for targeting mutations to non-selectable genes. Nature. 1988; 336(6197):348-52.

Marasco et al."Carbonic anhydrase IX: opportunities for immune-based approaches" Nov. 7, 2015.

Maude S L, Frey N, Shaw P A, Aplenc R, Barrett D M, Bunin N J, et al. Chimeric antigen receptor T cells for sustained remissions in leukemia. The New England journal of medicine. 2014; 371:1507-17.

McLaughlin et al. Adeno-associated virus general transduction vectors: analysis of proviral structures. J Virol. 1988; 62:1963-73.

Milone MC, Fish JD, Carpenito C, Carroll RG, Binder G K, Teachey D et al. Chimeric receptors containing CD137 signal transduction domains mediate enhanced survival of T cells and increased antileukemic efficacy in vivo. Molecular therapy: the journal of the American Society of Gene Therapy 2009; 17(8): 1453-64.

Miotti S, Negri D R, Valota 0, Calabrese M, Bolhuis R L, Gratama J W et al. Level of anti-mouseantibody response induced by bi-specific monoclonal antibody OC/TR in ovarian-carcinoma patients is associated with longer survival. International journal of cancer. Journal international du cancer 1999; 84(1): 62-8.

Mirzabekov T, Kontos H, Farzan M, Marasco W, Sodroski J. Paramagnetic proteoliposomes containing a pure, native, and oriented seven-transmembrane segment protein, CCRS. Nat Biotechnol 2000; 18(6): 649-54.

Mor F, Cohen IR. IL-2 rescues antigen-specific T cells from radiation or dexamethasone-induced apoptosis. Correlation with induction of Bcl-2. J Immunol 1996; 156(2): 515-22.

Murugaiyan G, Saha B. Protumor vs antitumor functions of IL-17. J Immunol 2009; 183(7): 4169-75.

Pardoll D M. The blockade of immune checkpoints in cancer immunotherapy. Nature reviews Cancer. 2012; 12:252-64.

Pastorekova S, Parkkila S, ParkkilaAK, Opaysky R, Zelnik V, Saarnio J et al. Carbonic anhydrase IX, MN/CA IX: analysis of stomach complementary DNA sequence and expression in human and rat alimentary tracts. Gastroenterology 1997; 112(2): 398-408.

Pegram et al. "Tumor-targeted T cells modified to secrete IL-12 eradicate systemic tumors without need for prior conditioning" Blood, The J. of Amer. Soc. Of Hematology 119. 18(2012):4133-4141.

Pegram H J, Park J H, Brentjens R J. CD28z CARs and armored CARs. Cancer J2014; 20(2): 127-33.

Pegram, Hollie J., et al. "Tumor-targeted T cells modified to secrete IL-12 eradicate systemic tumors without need for prior conditioning." Blood, The Journal of the American Society of Hematology 119.18 (2012): 4133-4141.

Saarnio J, Parkkila S, Parkkila AK, Waheed A, Casey M C, Zhou X Y et al. Immunohistochemistry of carbonic anhydrase isozyme IX (MN/CA IX) in human gut reveals polarized expression in the epithelial cells with the highest proliferative capacity. The journal of histochemistry and cytochemistry: official journal of the Histochemistry Society 1998; 46( 4): 497-504.

Sadelain et al: The Basic Principles of Chimeric Antigen Receptor Design, Cancer Discovery, vo. 3, No. 4, Apr. 1, 2013, pp. 388-398.

Sadelain M, Brentjens R, Riviere I. The promise and potential pitfalls of chimeric antigen receptors. Curr Opin Immunol 2009; 21(2): 215-23.

Sadelain, Michel, Renier Brentjens, and Isabelle Rivière. "The basic principles of chimeric antigen receptor design." Cancer discovery 3.4 (2013): 388-398.

Schaft N, Willemsen RA, de Vries J, Lankiewicz B, Essers B W, Gratama J W et al. Peptide fine specificity of anti-glycoprotein 100 CTL is preserved following transfer of engineered TCR alpha beta genes into primary human T lymphocytes. J Immunol 2003; 170(4): 2186-94.

Schwarzer A, Wolf B, Fisher J L, Schwaab T, Olek S, Baron U et al. Regulatory T-cells and associated pathways in metastatic renal

(56) References Cited

OTHER PUBLICATIONS cell carcinoma (mRCC) patients undergoing DC-vaccination and cytokinetherapy. PloS one 2012; 7 (10): e46600.
Sedlakova O, Svastova E, Takacova M, Kopacek J, Pastorek J, Pastorekova S. Carbonic anhydrase IX, a hypoxia-induced catalytic component of the pH regulating machinery in tumors. Frontiers in physiology. 2014; 4:400.
Singh H, Figliola M J, Dawson M J, Huls H, Olivares S, Switzer K, et al. Reprogramming CD19-specific T cells with IL-21 signaling can improve adoptive immunotherapy of B-lineage malignancies. Cancer research. 2011; 71:3516-27.
Song D G, Ye Q, Carpenito C, Poussin M, Wang LP, Ji C et al. In vivo persistence, tumor localization, and anti tumor activity of CAR-engineered T cells is enhanced by costimulatory signaling through CD137 (4-IBB). Cancer research 2011; 71(13): 4617-27.
Srivastava S, Riddell SR. Engineering CAR-T cells: Design concepts. Trends in immunology. 2015; 36:494-502.
Sui J, Aird DR, Tamin A, Murakami A, Yan M, Yammanuru A et al. Broadening of neutralization activity to directly block a dominant antibody-driven SARS coronavirus evolution pathway. PLoS pathogens 2008; 4(11): e1000197.
Thomas K R, Capecchi M R. Site-directed mutagenesis by gene targeting in mouse embryo-derived stem cells. Cell. 1987; 51(3):503-512.
Topalian SL, Hodi F S, Brahmer JR, Gettinger S N, Smith D C, McDermott D F, et al. Safety, activity, and immune correlates of anti-PD-1 antibody in cancer. The New England journal of medicine. 2012; 366:2443-54.
TPO mailed Mar. 18, 2020.
Tratschin et al. A human parvovirus, adeno-associated virus, as a eucaryotic vector: transient expression and encapsidation of the procaryotic gene for chloramphenicol acetyltransferase. Mol Cell Biol. 1984; 4(10):2072-81.
Virgin H W, Wherry E J, Ahmed R. Redefining chronic viral infection. Cell. 2009; 138:30-50.
Wald O, Weiss I D, Wald H, Shoham H, Bar-Shavit Y, Beider K et al. IFN-gamma acts on T cells to induce N K cell mobilization and accumulation in target organs. J Immunol 2006; 176(8): 4716-29.
Wayne A Marasco et al: "Carbonic Anhyddrase IX: Opportunities for Immune-Based Approaches". Nov. 7, 2015 (Nov. 7, 2015), Retrieved from the Internet: URL:http:/fwww.euikcs.com/kca/miami/does/h6-marasco.pdf.
Afreen et al. The immunoinhibitory B7-H1 molecule as a potential target in cancer: Killing many birds with one stone, Heamatol Cancer Stem Cell Ther 7:1-17 (2014).
Agnes Shuk-Yee Lo et al. Regression of established renal cell carcinoma in nude mice using lentivirus-transdued human T cells expressing a human anti-CAIX chimeric antigen receptor, Oncolytics 1, 14003; doi: 10/1038/mto.2014.3 (2014).
Brahmer, Julie R., et al. "Safety and activity of anti-PD-L1 antibody in patients with advanced cancer." New England Journal of Medicine 366.26 (2012): 2455-2465.
Jilaveanu et al. PD-L1 expression in clear cell renal cell carcinoma: an analysis of nepthrectomy and sites of metastases, J Cancer Therapy 5:166-172 (2014).
Third Party Observation in European patent application 15828615.3 mailed by European Patent Office on Mar. 18, 2020.
Atkins M, Regan M, McDermott D, Mier J, Stanbridge E, Youmans A et al. Carbonic anhydrase IX expression predicts outcome of interleukin 2 therapy for renal cancer. Clin Cancer Res 2005; 11(10): 3714-21.
Bar E, Whitney PG, Moor K, Reise Sousa C, Leibund Gut-Landmann S. IL-1 7 regulates systemic fungal immunity by controlling the functional competence of NK cells. Immunity 2014; 40(1): 117-27.
Blomer et al. Highly efficient and sustained gene transfer in adult neurons with a lentivirus vector. J Virol. 1997; 71(9): 6641-9.
Carpenito C, Milone M C, Hassan R, Simonet J C, Lakhal M, Suhoski M M et al. Control of large, established tumor xenografts with genetically retargeted human T cells containing CD28 and CD137 domains. Proceedings of the National Academy of Sciences of the United States of America 2009; 106(9): 3360-5.
Carpenter, Robert O., et al. "B-cell maturation antigen is a promising target for adoptive T-cell therapy of multiple myeloma." Clinical cancer research 19.8 (2013): 2048-2060.
Chang DK, Moniz R J, Xu Z, Sun J, Signoretti S, Zhu Q, et al. Human anti-CAIX antibodies mediate immune cell inhibition of renal cell carcinoma in vitro and in a humanized mouse model in vivo. Molecular cancer. 2015; 14:119.
Cotten et al. High-efficiency receptor-mediated delivery of small and large (48 kilobase) gene constructs using the endosome activity of defective or chemically inactivated adenovirus particles. Proc Natl Acad Sci U.S.A. 1992; 89 (13):6094-8.
Dudley M E, Wunderlich J R, Robbins P F, Yang J C, Hwu P, Schwartzentruber D J et al. Cancer regression and autoimmunity in patients after clonal repopulation with antitumor lymphocytes. Science 2002; 298(5594): 850-4.
Dutcher JP. Recent developments in the treatment of renal cell carcinoma. Therapeutic advances in urology. 2013; 5:338-53.
EP examination report for EP Application No. 15828615.3, Apr. 6, 2018.
Ferlay J, Soerjomataram I, Dikshit R, Eser S, Mathers C, Rebelo M, et al. Cancer incidence and mortality worldwide: sources, methods and major patterns in GLOBOCAN 2012. International journal of cancer. 2015; 136:E359-86.
Frigola X, Inman BA, Lohse C M, Krco C J, Cheville J C, Thompson R H et al. Identification of a soluble form of B7-HI that retains immunosuppressive activity and is associated with aggressive renal cell carcinoma. Clin Cancer Res 2011; 17(7): 1915-23.
GenBank accession No. GQ903548, Jul. 25, 2016.
GenBank accession No. GQ903549, Jul. 25, 2016.
GenBank accession No. GQ903550, Jul. 25, 2016.
GenBank accession No. GQ903551, Jul. 25, 2016.
GenBank accession No. GQ903552, Jul. 25, 2016.
GenBank accession No. GQ903553, Jul. 25, 2016.
GenBank accession No. GQ903554, Jul. 25, 2016.
GenBank accession No. GQ903555, Jul. 25, 2016.
GenBank accession No. GQ903556, Jul. 25, 2016.
GenBank accession No. GQ903557, Jul. 25, 2016.
GenBank accession No. GQ903558, Jul. 25, 2016.
GenBank accession No. GQ903559, Jul. 25, 2016.
GenBank accession No. GQ903560, Jul. 25, 2016.
GenBank accession No. GQ903561, Jul. 25, 2016.
Genega EM, Ghebremichael M, Najarian R, Fu Y, Wang Y, Argani P, et al. Carbonic anhydrase IX expression in renal neoplasms: correlation with tumor type and grade. American journal of clinical pathology. 2010; 134:873-9.
Gill S, Tasian SK, Ruella M, Shestova O, Li Y, Porter D L et al. Efficacy against human acute myeloid leukemia and myeloablation of normal hematopoiesis in a mouse model using chimeric antigen receptor-modified T cells. Blood 2014.
Grepin R, Guyot M, Giuliano S, Boncompagni M, Ambrosetti D, Chamorey E et al. The CXCL 7 I CXCRI/2 axis is a key driver in the growth of clear cell renal cell carcinoma. Cancer research 2014; 74(3): 873-83.
Han, et al. Human anti-CCR4 minibody gene transfer for the treatment of cutaneous t-cell lymphoma; PLOS ONE, 2012, vol. 7, Issue 9, e44455.
Tarshman LC, Drake CG, Choueiri T K. PD-1 blockade in renal cell carcinoma: to equilibrium and beyond. Cancer immunology research. 2014; 2:1132-41.
Hilvo M, Baranauskiene L, Salzano A M, Scaloni A, Matulis D, Innocenti A et al. Biochemical characterization of CA IX, one of the most active carbonic anhydrase isozymes. J Biol Chem 2008; 283(41): 27799-809.
Hinrichs CS, Kaiser A, Paulos CM, Cassard L, Sanchez-Perez L, Heemskerk B et al. Type 17 CDS+ T cells display enhanced antitumor immunity. Blood 2009; 114(3): 596-9.
Hombach A A, Heiders J, Foppe M, Chmielewski M, Abken H. OX40 costimulation by a chimeric antigen receptor abrogates CD28 and IL-2 induced IL-10 secretion by redirected CD4(+) T cells. Oncoimmunology 2012; 1( 4): 458-466.

(56) References Cited

OTHER PUBLICATIONS

Hombach A A, Rappl G, Abken H. Arming cytokine-induced killer cells with chimeric antigen receptors: CD28 putperforms combined CD28-0X40 "superstimulation". Molecular therapy: the journal of the American Society of Gene Therapy 2013; 21(12): 2268-77.

HombachA, Koch D, Sircar R, Heuser C, Diehl V, Kruis W et al. A chimeric receptor that selectively targets membrane-pound carcinoembryonic antigen (mCEA) in the presence of soluble CEA. Gene Ther 1999; 6(2): 300-4.

Horwich et al. Synthesis of Hepadnavirus Particles That Contain Replication-Defective Duck Hepatitis B Virus Genomes in Cultured HuH7 Cells. J Virol. 1990; 64(2): 642-50.

Hoyos, Valentina, et al. "Engineering CD19-specific T lymphocytes with interleukin-15 and a suicide gene to enhance their anti-lymphoma/leukemia effects and safety." Leukemia 24.6 (2010): 1160-1170.

Inouye et al. Up-promoter mutations in the Ipp gene of *Escherichia coli*. Nucleic Acids Res. 1985; 13(9): 3101-3110.

International Report on Patentability; WO2016100985; Jun. 20, 2017.

International Search Report, WO2016100985, Jul. 1, 2016.

Isakov N, Altman A. PKC-theta-mediated signal delivery from the TCR/CD28 surface receptors. Frontiers in immunology 2012; 3: 273.

Ivanov S, Liao S Y, Ivanova A, Danilkovitch-Miagkova A, Tarasova N, Weirich G et al. Expression of hypoxia-inducible cell-surface transmembrane carbonic anhydrases in human cancer. Am J Pathol 2001; 158(3): 905-19.

John L B, Devaud C, Duong C P, Yong C S, Beavis P A, Haynes N M, et al. Anti-PD-1 antibody therapy potently enhances the eradication of established tumors by gene-modified T cells. Clinical cancer research: an official journal of the American Association for Cancer Research. 2013; 19:5636-46.

Blank, Christian, and Andreas Mackensen. "Contribution of the PD-L1/PD-1 pathway to T-cell exhaustion: an update on implications for chronic infections and tumor evasion." Cancer immunology, immunotherapy 56 (2007): 739-745.

Stillebroer et al. Carbonic anhydrase IX in renal cell carcinoma: implications for prognosis, diagnosis, and therapy.

\* cited by examiner

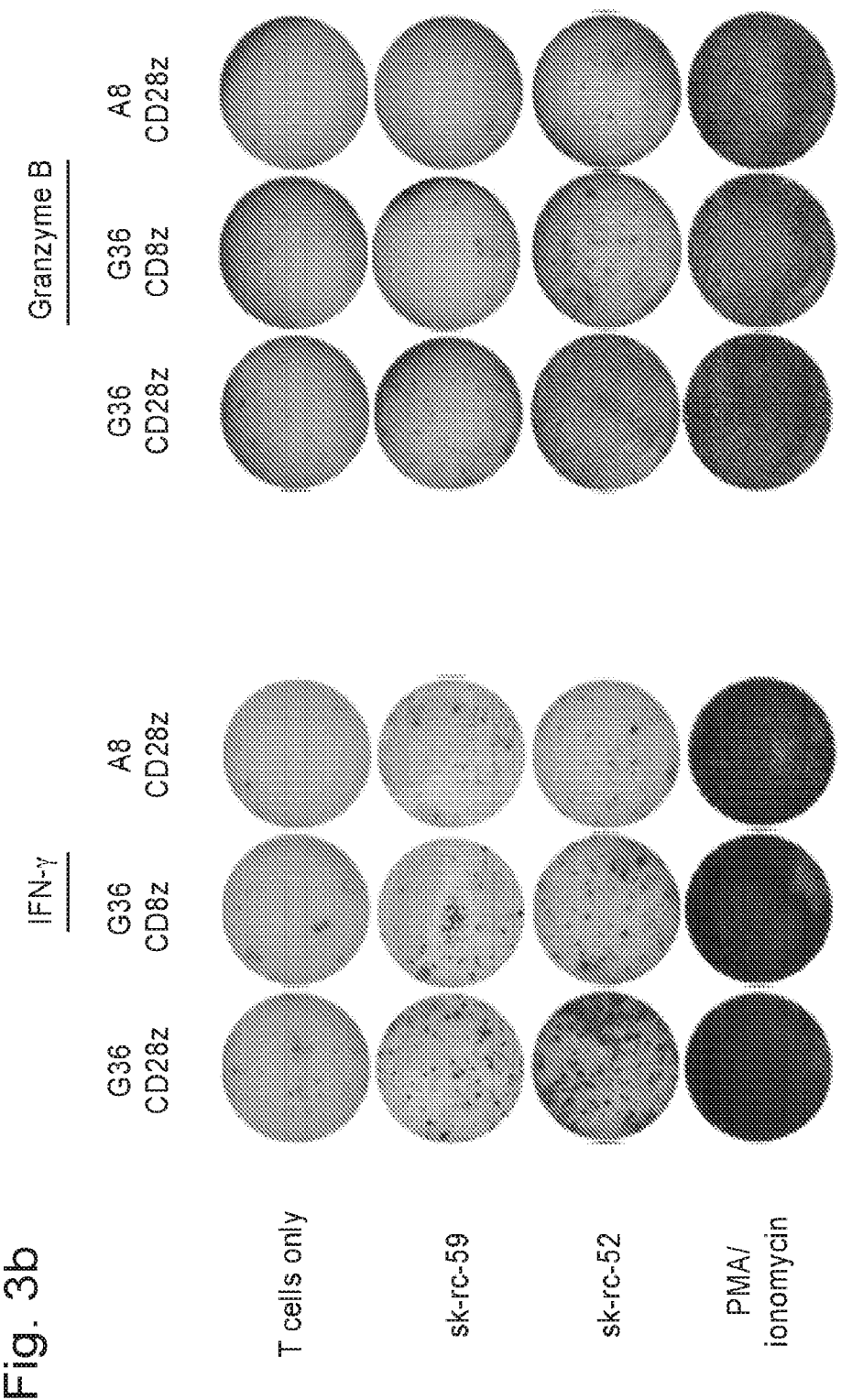

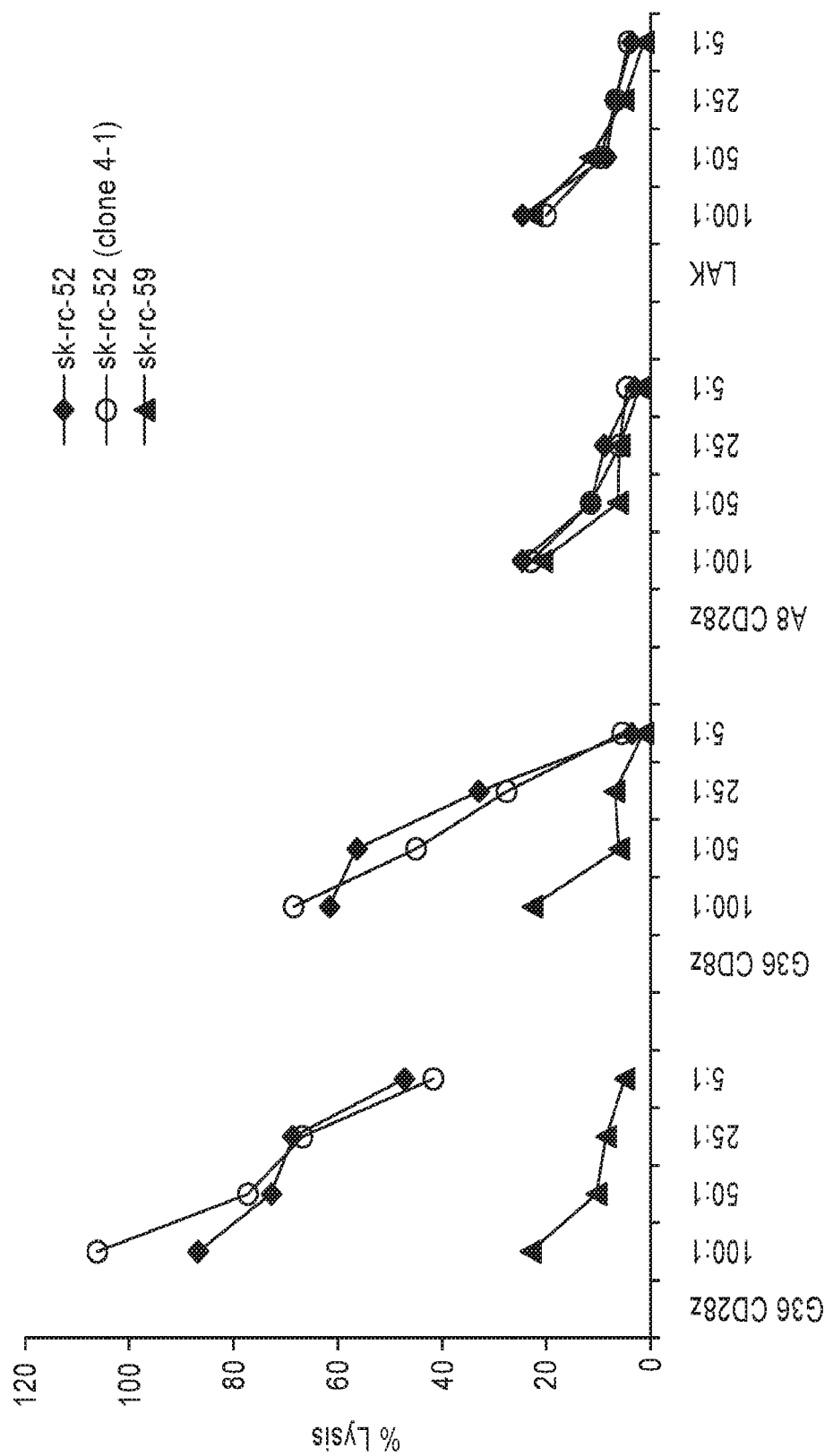

Experiment 1

Experiment 2

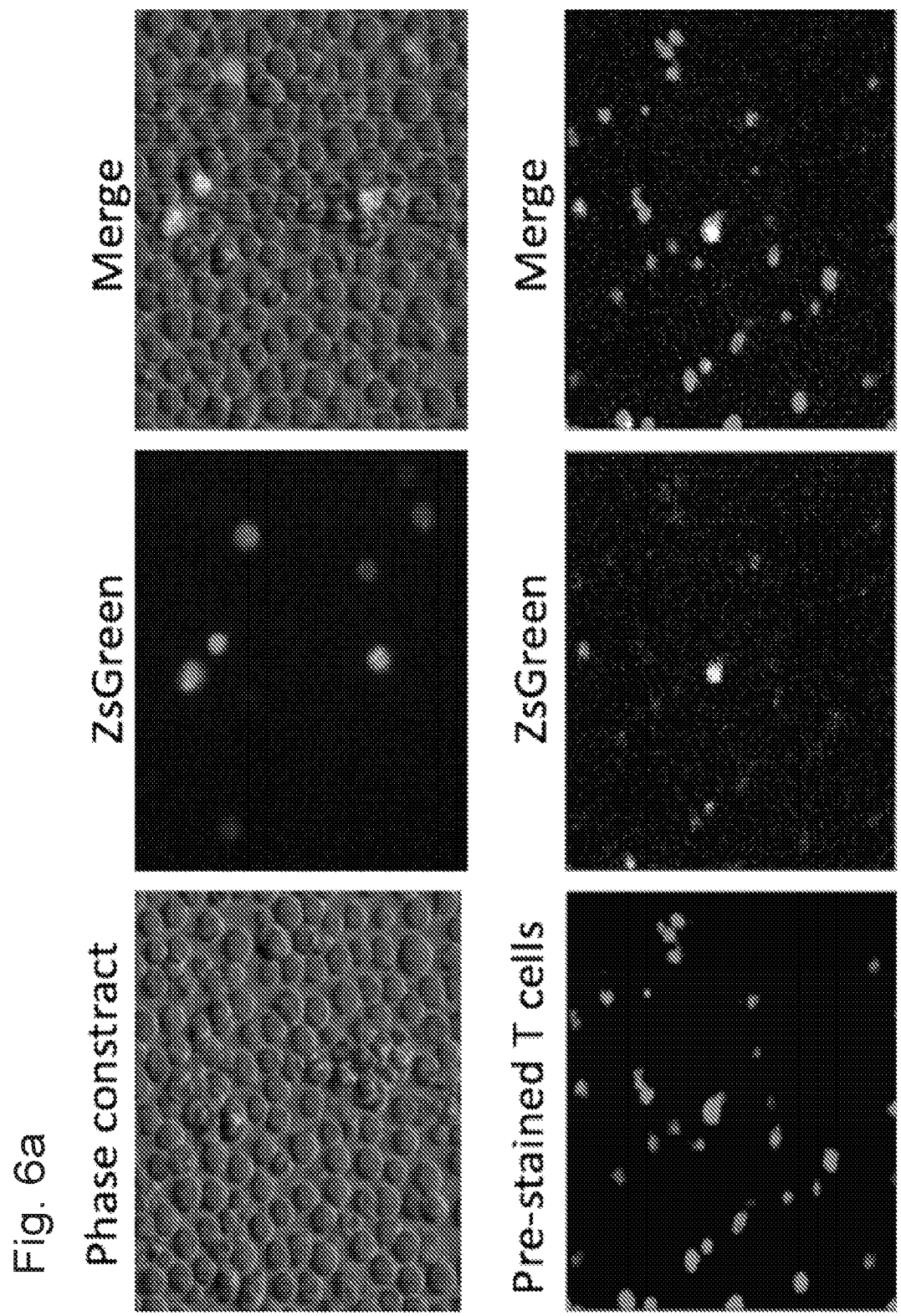

40x  200x 40x　　　　　　　　　　　　40x 200x　　　　　　　　　　　200x

A

CHIMERIC ANTIGEN RECEPTORS AND METHODS OF USE THEREOF

RELATED APPLICATIONS

This application is a continuation of U.S. patent application Ser. No. 15/537,779 which is a National State Entry of PCT application number PCT/US2015/067255 which claims priority to, and the benefit of U.S. Provisional Application No. 62/094,625 filed on Dec. 19, 2014, and U.S. Provisional Application No. 62/252,083 filed on Nov. 6, 2015, the contents of each of which are hereby incorporated in their entireties.

GOVERNMENT INTEREST

This invention was made with government support under Grant No. DK072282 awarded by the National Institutes of Health. The government has certain rights in the invention.

INCORPORATION-BY-REFERENCE OF SEQUENCE LISTING

The contents of the ASCII text file named, "5031461-035-US3_SL.txt", which was created on Mar. 22, 2019, and is 899,825 bytes is size, are hereby incorporated by reference in their entirety.

FIELD OF THE INVENTION

The present invention relates generally to chimeric antigen receptor cells for and methods of using same for treatment cancer and other disorders.

BACKGROUND OF THE INVENTION

T lymphocytes recognize specific antigens through interaction of the T cell receptor (TCR) with short peptides presented by major histocompatibility complex (MHC) class I or II molecules. For initial activation and clonal expansion, naive T cells are dependent on professional antigen-presenting cells (APCs) that provide additional co-stimulatory signals. TCR activation in the absence of co-stimulation can result in unresponsiveness and clonal anergy. To bypass immunization, different approaches for the derivation of cytotoxic effector cells with grafted recognition specificity have been developed. Chimeric antigen receptors (CARs) have been constructed that consist of binding domains derived from natural ligands or antibodies specific for cell-surface antigens, genetically fused to effector molecules such as the TCR alpha and beta chains, or components of the TCR-associated CD3 complex. Upon antigen binding, such chimeric antigen receptors link to endogenous signaling pathways in the effector cell and generate activating signals similar to those initiated by the TCR complex. Since the first reports on chimeric antigen receptors, this concept has steadily been refined and the molecular design of chimeric receptors has been optimized. Aided by advances in recombinant antibody technology, chimeric antigen receptors targeted to a wide variety of antigens on the surface of cancer cells and of cells infected by human immunodeficiency virus (HIV) have been generated.

SUMMARY OF THE INVENTION

In various aspects the invention provides a chimeric antigen receptor (CAR) having an intracellular signaling domain, a transmembrane domain and an extracellular domain.

In some aspects the transmembrane domain further includes a stalk region positioned between the extracellular domain and the transmembrane domain. The transmembrane domain includes CD28. In another aspect the CAR further includes one or more additional costimulatory molecules positioned between the transmembrane domain and the intracellular signaling domain. The costimulatory molecules is CD28, 4-1BB, ICOS, or OX40. The intracellular signaling domain is for example a CD3 zeta chain. The extracellular domain is an antibody such as a Fab or a scFV. Preferably the antibody is specific for BCMA, CA-9, CD138, CCR4, or the influenza virus.

Also included in the invention are nucleic acids encoding the CAR of the invention further including a nucleic acid encoding a polypeptide positioned after the intracellular signaling domain. The polypeptide is an antibody such as scFV. Preferably, the antibody is specific for CCR4, PD-1, PDL-1, PD-L2, CXCR4, or GITR. Also provided by the invention are vector including the nucleic acid according to the invention and cells including the vectors.

In yet a further aspect the invention provides a genetically engineered cell which express and bear on the cell surface membrane the chimeric antigen receptor of the invention. The cell is a T-cell or an NK cell. The T cell is CD4$^+$ or CD8$^+$. The cell is a mixed population of CD4$^+$ and CD8 cells$^+$. The cell is further engineered to express and secrete a polypeptide such as for example an antibody.

Unless otherwise defined, all technical and scientific terms used herein have the same meaning as commonly understood by one of ordinary skill in the art to which this invention pertains. Although methods and materials similar or equivalent to those described herein can be used in the practice of the present invention, suitable methods and materials are described below. All publications, patent applications, patents, and other references mentioned herein are expressly incorporated by reference in their entirety. In cases of conflict, the present specification, including definitions, will control. In addition, the materials, methods, and examples described herein are illustrative only and are not intended to be limiting.

Other features and advantages of the invention will be apparent from and encompassed by the following detailed description and claims.

BRIEF DESCRIPTION OF THE DRAWINGS

FIG. 1A, CAIX+ sk-rc-09 cells; FIG. 1B, CAIX+ sk-rc-52 cells; FIG. 1C, CAIX− sk-rc-59 cells.

FIG. 2A. Construction: The 1$^{st}$ generation CAR, scFv-CD8-TCRζ (CD8 CAR), is composed of a specific anti-CAIX scFv that is coupled to truncated human CD8α extracellular domain, hinge (H), transmembrane (TM) and intracellular regions, then to the signaling domain of human TCRζ. The 2$^{nd}$ generation CAR, scFv-CD28-TCRζ (CD28 CAR), contains anti-CAIX scFv fused with human CD28 extracellular, TM and intracellular signaling domain to TCRζ. Both anti-CAIX CARs were cloned into a bicistronic self-inactivating (SIN) lentiviral vector with expression driven by an internal eF1-α promoter. The CAR control construct contains an irrelevant anti-HIV CCR5 specific A8 scFv substitution. FIG. 2B. FACS analysis: Reporter gene ZsGreen was used to quantitate primary T cell transduction efficiency by the lentiviral CAR constructs. In addition, anti-CAIX scFv CARs were stained with CAIX-Fc fusion protein and C9-tag (TETSQVAPA (SEQ ID NO: 1678)) was stained with 1D4 antibody. Untransduced activated T-cells, LAK only were served as unstained cell control (i) or stained with $2^{nd}$ antibody (ii. PE-anti-human IgG and iii. APC-anti-mouse IgG) were used as staining controls. FIG. 2C. Western blot: Molecular sizes of monomer/dimer structures of anti-CAIX (clone G36) CD28 and anti-CCR5 (clone A8) CD28 CARs, as well as endogenous TCRζ chain of untransduced T cells were indicated.

FIG. 3A-FIG. 3C. Effector functions of CAIX-specific CARTs. FIG. 3A. Cytokine secretion. Anti-CAIX CART, irrelevant CART or activated control T cells (LAK) were cocultivated overnight with kidney cancer cell lines sk-rc-52 (CAIX+) and sk-rc-59 (CAIX−) for cytokine production. One representative out of 2-3 results is shown. FIG. 3B. ELISPOT. G36 CART or control A8 CART cells were added to tumor cells overnight. IFN-γ or granzyme B secreting T cells detected by ELISPOT. Similar results were obtained in 2-3 experiments. FIG. 3C. Specific anti-tumor cytotoxicity of CAIX-specific CART cells, control A8 CART cells or LAK cells were incubated in a 4-hour cytotoxicity assay at different amounts of target tumor cell at the ratios as indicated. One out of two experiments is shown. Clone 4-1 is a in vivo passaged subclone of sk-rc-52.

FIG. 6A-FIG. 6C. In vivo anti-tumor activity of CAR+ T-cells. FIG. 6A. Expression of ZsGreen by CART cells is shown in upper panel. CART cells were pre-stained with Far Red dye, cytospun and examined by fluorescent microscopy (lower panel). FIG. 6B. In situ staining of G36 CD28 CART cells in regressing tumor. CART-cells were i.v. injected into RCC established mice and tumor tissue was collected on day 1-3. Confocal microscopy was used to measure apoptosis of tumor cells by TUNNEL assay with PE-Cy5 dye (shown as red). Transduced T cells were shown by ZsGreen. Nuclei were counterstained with DPAI. Two representative slides were shown to indicate the apoptosis of tumor cells at the edge of tumor (upper panel) and inside the tumor bed (middle panel), respectively. The magnified image (lower panel) demonstrates CART cells interacted with multiple tumors while a few surrounding tumor cells were dying. FIG. 6C. Granzyme B+ T cells and tumor necrosis. After the treatment with CART cells, the regressing CAIX+ sk-rc-52 tumors were stained by granzyme B antibody (brown) and H&E. The higher magnification view (middle and lower panels of sections a and b in upper panel) shows the locations of granzyme B+ T cells (shown by arrows) and the corresponding H&E slide shows the tumor necrosis (shown by n). Granzyme B+ T cells are distributed at the edge of tumor (middle panel) and inside the tumor (lower panel).

DETAILED DESCRIPTION OF THE INVENTION

Figure 1A:
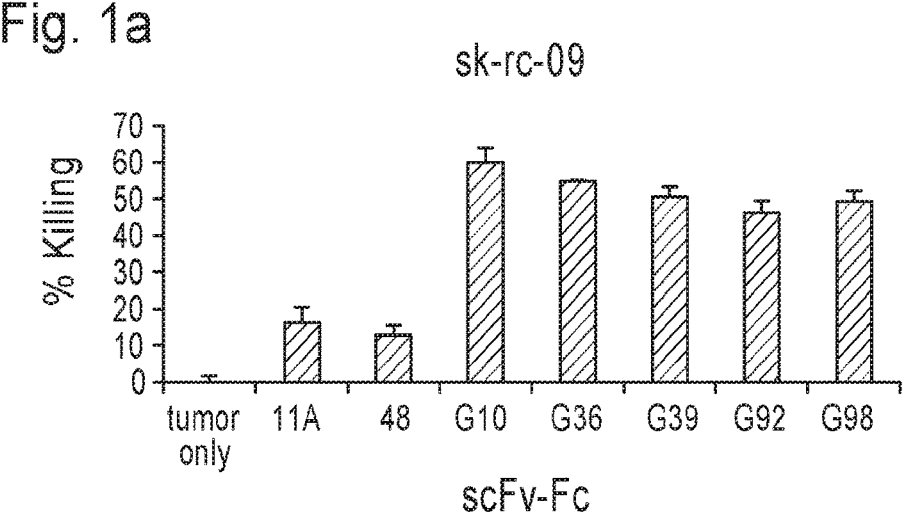
FIG. 1A-FIG. 1C. ADCC of CAIX-specific Abs. 1 µg/ml CAIX-specific scFv-Fc minibodies were added to the target tumor cells in the presence of human PBMC (E:T 25:1). Similar results were obtained in 2 experiments. Irrelevant anti-SARS scFv-Fc (11A) and anti-CCR4 scFv-Fc (48) minibodies were used as negative controls.

The present invention relates to a chimeric antigen receptor (CAR) particularly adapted to immune cells used in immunotherapy.

In one embodiment, a double immunotherapeutic strategy is described based on the blocking of T cell exhaustion using anti-PD-L1 antibodies secreted by targeted anti-CAIX CAR T cells combined in a single lentivirus construct for improving cancer treatment.

An emerging mechanism associated with the progression of RCC and other tumors is the immune checkpoint pathway, which consists in cellular interactions that prevent excessive activation of T cells under normal conditions, allowing T cell function in a self-limited manner. As an evasion mechanism, many tumors are able to stimulate the expression of immune checkpoint molecules, resulting in an anergic phenotype of T cells that cannot restrain tumor progression. Emerging clinical data highlight the importance of one inhibitory ligand and receptor pair as an immune checkpoint: the programmed death-ligand 1 (PD-L1; B7-H1 and CD274) and programmed death receptor-1 (PD-1; CD279), in preventing killing of cancer cells by cytotoxic T-lymphocytes. PD1 receptor is expressed by many cell types like T cells, B cells, Natural Killer cells (NK) and host tissues. Tumors and Antigen-presenting cells (APC) expressing PD-L1 can block T cell receptor (TCR) signaling of cytotoxic T-lymphocytes through binding to receptor PD-1, decreasing the production of cytokines and T cell proliferation. PD-L1 overexpression can be found in many tumor types and may also mediate an immunosuppressive function through its interaction with other proteins, including CD80 (B7.1), blocking its ability to activate T cells through binding to CD28.

Genetic engineering of human lymphocytes to express tumor-directed chimeric antigen receptors (CAR) can produce antitumor effector cells that bypass tumor immune escape mechanisms that are due to abnormalities in protein-antigen processing and presentation. Moreover, these transgenic receptors can be directed to tumor-associated antigens that are not protein-derived. In certain embodiments of the invention there are lymphocytes (CARTS) that are modified to comprise at least a CAR, and in particular embodiments of the invention a single CAR targets two or more antigens. In preferred embodiments, the CARTS are further modified to express and secrete one or more polypeptides, such as for example an antibody or a cytokine. Such CARTS are referred to herein as armed CARTS. Armed CARTS allow for simultaneous secretion of the polypeptide locally at the targeted site (i.e., tumor site).

A modified TCR called chimeric antigen receptor (CAR) containing single chain variable antibody fragment (scFv) previously selected by high affinity against a specific tumor associated antigen is a powerful new approach against cancer. The scFv presented in the CAR is linked to an intracellular signaling block that includes CD3$\zeta$ to induce T cell activation followed by antigen binding. This structure is characteristic for first-generation CARs, which were improved to second- and generation CARs that link the signaling co-stimulatory endodomains of CD28, 4-1BB, or OX40 to CD3 or $3^{rd}$-generation CARs that links two elements to CD3$\zeta$ in tandem. These endodomains are required for complete T cell activation during TCR recognition by antigen-presenting cells (APCs), improving cytokine production and proliferation of CAR-T cells. The effect of CART cells has heretofore been modest for the treatment of solid tumors, due to difficulty in finding unique tumor associated antigens, inefficient homing of T cells to tumor locations, low persistence of T cells in the body and the immunosuppressive microenvironment of solid tumors.

In particular cases, the lymphocytes include a receptor that is chimeric, non-natural and engineered at least in part by the hand of man. In particular cases, the engineered chimeric antigen receptor (CAR) has one, two, three, four, or more components, and in some embodiments the one or more components facilitate targeting or binding of the lymphocyte to one or more tumor antigen-comprising cancer cells.

The CAR according to the invention generally comprises at least one transmembrane polypeptide comprising at least one extracellular ligand-biding domain and; one transmembrane polypeptide comprising at least one intracellular signaling domain; such that the polypeptides assemble together to form a Chimeric Antigen Receptor.

The term "extracellular ligand-binding domain" as used herein is defined as an oligo- or polypeptide that is capable of binding a ligand. Preferably, the domain will be capable of interacting with a cell surface molecule. For example, the extracellular ligand-binding domain may be chosen to recognize a ligand that acts as a cell surface marker on target cells associated with a particular disease state.

In particular, the extracellular ligand-binding domain can comprise an antigen binding domain derived from an antibody against an antigen of the target.

As non limiting examples, the antigen of the target can be a tumor-associated surface antigen, such as ErbB2 (HER2/neu), carcinoembryonic antigen (CEA), epithelial cell adhesion molecule (EpCAM), epidermal growth factor receptor (EGFR), EGFR variant III (EGFRvIII), CD19, CD20, CD30, CD40, disialoganglioside GD2, ductal-epithelial mucine, gp36, TAG-72, glycosphingolipids, glioma-associated antigen, .beta.-human chorionic gonadotropin, alphafetoprotein (AFP), lectin-reactive AFP, thyroglobulin, RAGE-1, MN-CA IX, human telomerase reverse transcriptase, RU1, RU2 (AS), intestinal carboxyl esterase, mut hsp70-2, M-CSF, prostase, prostase specific antigen (PSA), PAP, NY-ESO-1, LAGA-1a, p53, prostein, PSMA, surviving and telomerase, prostate-carcinoma tumor antigen-1 (PCTA-1), MAGE, ELF2M, neutrophil elastase, ephrin B2, CD22, insulin growth factor (IGF1)-I, IGF-II, IGFI receptor, mesothelia, a major histocompatibility complex (MHC) molecule presenting a tumor-specific peptide epitope, 5T4, ROR1, Nkp30, NKG2D, tumor stromal antigens, the extra domain A (EDA) and extra domain B (EDB) of fibronectin and the A1 domain of tenascin-C (TnC A1) and fibroblast associated protein (fap); a lineage-specific or tissue specific antigen such as CD3, CD4, CD8, CD24, CD25, CD33, CD34, CD133, CD138, CTLA-4, B7-1 (CD80), B7-2 (CD86), endoglin, a major histocompatibility complex (MHC) molecule, BCMA (CD269, TNFRSF 17), or a virus-specific surface antigen such as an HIV-specific antigen (such as HIV gp120); an EBV-specific antigen, a CMV-specific antigen, a HPV-specific antigen, a Lasse Virus-specific antigen, an Influenza Virus-specific antigen as well as any derivate or variant of these surface markers.

Preferably, the CAR is specific for BMCA, CAIX, CCR4, PD-L1, PD-L2, PD1, Glucocorticoid-Induced Tumor Necrosis Factor Receptors (GITR), Severe acute respiratory syndrome (SARS), influenza, flavivirus or Middle East Respiratory Syndrome (MERS).

In a preferred embodiment, said extracellular ligand-binding domain is a single chain antibody fragment (scFv) comprising the light ($V_L$) and the heavy ($V_H$) variable fragment of a target antigen specific monoclonal antibody joined by a flexible linker.

In a more preferred embodiment, said scFv antibody is specific for BMCA, CAIX, CCR4, PD-L1, PD-L2, PD1, GITR, SARS, influenza, flavivirus or MERS.

Exemplary antibodies useful in constructing the CAR according to the invention includes antibodies disclosed in for example: WO/2005/060520, WO/2006/089141, WO/2007/065027, WO/2009/086514, WO/2009/079259, WO/2011/153380, WO/2014/055897, WO 2015/143194, WO 2015/164865, WO 2013/166500, and WO 2014/144061; PCT/US2015/054202, PCT/US2015/054010 and 62/144,729 the contents of which are hereby incorporated by reference in their entireties.

PDL1 (68)

Exemplary anti-PDL1 antibodies include antibodies having containing a vH nucleotide sequence having SEQ ID NO: 1485 and a vL nucleotide sequence having SEQ ID NO: 1487; a VH nucleotide sequence having SEQ ID NO: 1485 and a VL nucleotide sequence having SEQ ID NO: 1487; a VH nucleotide sequence having SEQ ID NO: 1489 and a VL nucleotide sequence having SEQ ID NO: 1491; a VH nucleotide sequence having SEQ ID NO: 1493 and a VL nucleotide sequence having SEQ ID NO: 1495; a VH nucleotide sequence having SEQ ID NO: 1497 and a VL nucleotide sequence having SEQ ID NO: 1499; a VH nucleotide sequence having SEQ ID NO: 1501 and a VL nucleotide sequence having SEQ ID NO: 1503; a VH nucleotide sequence having SEQ ID NO: 1505 and a VL nucleotide sequence having SEQ ID NO: 1507; a VH nucleotide sequence having SEQ ID NO: 1509 and a VL nucleotide sequence having SEQ ID NO: 1511; a VH nucleotide sequence having SEQ ID NO: 1513 and a VL nucleotide sequence having SEQ ID NO: 1515; a VH nucleotide sequence having SEQ ID NO: 1517 and a VL nucleotide sequence having SEQ ID NO: 1519; a VH nucleotide sequence having SEQ ID NO: 1521 and a VL nucleotide sequence having SEQ ID NO: 1523; a VH nucleotide sequence having SEQ ID NO: 1525 and a VL nucleotide sequence having SEQ ID NO: 1527; a VH nucleotide sequence having SEQ ID NO: 1529 and a VL nucleotide sequence having SEQ ID NO: 1531; a VH nucleotide sequence having SEQ ID NO: 1533 and a VL nucleotide sequence having SEQ ID NO: 1535; a VH nucleotide sequence having SEQ ID NO: 1537 and a VL nucleotide sequence having SEQ ID NO: 1539.

Exemplary anti-PDL1 antibodies include antibodies having containing a vH amino acid sequence having SEQ ID NO: 970 and a vL amino acid sequence having SEQ ID NO: 971; a VH amino acid having SEQ ID NO: 1486 and a VL polypeptide sequence having SEQ ID NO: 1488 a VH amino acid having SEQ ID NO: 1490 and a VL polypeptide sequence having SEQ ID NO: 1492 a VH amino acid having SEQ ID NO: 1494 and a VL polypeptide sequence having SEQ ID NO: 1496 a VH amino acid having SEQ ID NO: 1498 and a VL polypeptide sequence having SEQ ID NO: 1500 a VH amino acid having SEQ ID NO: 1502 and a VL polypeptide sequence having SEQ ID NO: 1504 a VH amino acid having SEQ ID NO: 1506 and a VL polypeptide sequence having SEQ ID NO: 1508 a VH amino acid having SEQ ID NO: 1510 and a VL polypeptide sequence having SEQ ID NO: 1512 a VH amino acid having SEQ ID NO: 1514 and a VL polypeptide sequence having SEQ ID NO: 1516 a VH amino acid having SEQ ID NO: 1518 and a VL polypeptide sequence having SEQ ID NO: 1520 a VH amino acid having SEQ ID NO: 1522 and a VL polypeptide sequence having SEQ ID NO: 1524 a VH amino acid having SEQ ID NO: 1526 and a VL polypeptide sequence having SEQ ID NO: 1528 a VH amino acid having SEQ ID NO: 1530 and a VL polypeptide sequence having SEQ ID NO: 1532 a VH amino acid having SEQ ID NO: 1534 and a VL polypeptide sequence having SEQ ID NO: 1536 a VH amino acid having SEQ ID NO: 1538 and a VL polypeptide sequence having SEQ ID NO: 1540.

In other embodiments the anti-PDL1 antibodies have a heavy chain with three CDRs including the amino acid sequences SEQ ID NO: 1541, 1554, 1569 respectively and a light chain with three CDRs including the amino acid sequences 1584, 1599, 1610 respectively; or a heavy chain with three CDRs comprising the amino acid sequences 1543, 1556, 1571 and a light chain with three CDRs comprising the amino acid sequences 1586, 1600, 1612; or a heavy chain with three CDRs comprising the amino acid sequences 1544, 1557, 1572 and a light chain with three CDRs comprising the amino acid sequences 1587, 1601, 1613; or a heavy chain with three CDRs comprising the amino acid sequences 1545, 1558, 1573 and a light chain with three CDRs comprising the amino acid sequences 1588, 1602, 1614; or a heavy chain with three CDRs comprising the amino acid sequences 1546, 1559, 1574 and a light chain with three CDRs comprising the amino acid sequences 1589, 1603, 1615; or a heavy chain with three CDRs comprising the amino acid sequences 1547, 1560, 1575 and a light chain with three CDRs comprising the amino acid sequences 1590, 1604, 1616; or a heavy chain with three CDRs comprising the amino acid sequences 1548, 1561, 1576 and a light chain with three CDRs comprising the amino acid sequences 1591, 1605, 1617; or a heavy chain with three CDRs comprising the amino acid sequences 1541, 1562, 1577 and a light chain with three CDRs comprising the amino acid sequences 1592, 1599, 1618; or a heavy chain with three CDRs comprising the amino acid sequences 1549, 1563, 1578 and a light chain with three CDRs comprising the amino acid sequences 1593, 1606, 1619; or a heavy chain with three CDRs comprising the amino acid sequences 1550, 1564, 1579 and a light chain with three CDRs comprising the amino acid sequences 1594, 1607, 1620; or a heavy chain with three CDRs comprising the amino acid sequences 1551, 1565, 1580 and a light chain with three CDRs comprising the amino acid sequences 1595, 1599, 1621; or a heavy chain with three CDRs comprising the amino acid sequences 1542, 1566, 1581 and a light chain with three CDRs comprising the amino acid sequences 1596, 1599, 1622; or a heavy chain with three CDRs comprising the amino acid sequences 1552, 1567, 1582 and a light chain with three CDRs comprising the amino acid sequences 1597, 1608, 1623; or a heavy chain with three CDRs comprising the amino acid sequences 1553, 1568, 1583 and a light chain with three CDRs comprising the amino acid sequences 1598, 1609 1624.

SARS (26)

Exemplary SARS neutralizing antibodies include antibodies having containing a vh nucleotide sequence having SEQ ID NO: 1626 and a vl nucleotide sequence having SEQ ID NO: 1628; a VH nucleotide sequence having SEQ ID NO: 1630 and a VL nucleotide sequence having SEQ ID NO: 1639; a VH nucleotide sequence having SEQ ID NO: 1634 and a VL nucleotide sequence having SEQ ID NO: 1640; a VH nucleotide sequence having SEQ ID NO: 1632 and a VL nucleotide sequence having SEQ ID NO: 1641; a VH nucleotide sequence having SEQ ID NO: 1633 and a VL nucleotide sequence having SEQ ID NO: 1642; a VH nucleotide sequence having SEQ ID NO: 1634 and a VL nucleotide sequence having SEQ ID NO: 1643; a VH nucleotide sequence having SEQ ID NO: 1635 and a VL nucleotide sequence having SEQ ID NO: 1644; a VH nucleotide sequence having SEQ ID NO: 1636 and a VL nucleotide sequence having SEQ ID NO: 1645; a VH nucleotide sequence having SEQ ID NO: 1637 and a VL nucleotide sequence having SEQ ID NO: 1646

CXCR4 (33)

Exemplary anti-CXCR4 antibody include antibodies having a VH amino acid sequence having SEQ ID NO: 771 and a VL amino acid sequence having SEQ ID NO: 779; a VH amino acid sequence having SEQ ID NO: 772 and a VL amino acid sequence having SEQ ID NO: 780; a VH amino acid sequence having SEQ ID NO: 773 and a VL amino acid sequence having SEQ ID NO: 781; a VH amino acid sequence having SEQ ID NO: 774 and a VL amino acid sequence having SEQ ID NO: 782; a VH amino acid sequence having SEQ ID NO: 775 and a VL amino acid sequence having SEQ ID NO: 783; a VH amino acid sequence having SEQ ID NO: 776 and a VL amino acid sequence having SEQ ID NO: 784; a VH amino acid sequence having SEQ ID NO: 777 and a VL amino acid sequence having SEQ ID NO: 785; or a VH amino acid sequence having SEQ ID NO: 778 and a VL amino acid sequence having SEQ ID NO: 786.

In other embodiments the anti-CXCR4 antibodies have a heavy chain with three CDRs including the amino acid sequences SEQ ID NO: 803, 804, 805 respectively and a light chain with three CDRs including the amino acid sequences 806, 807, 808 respectively; or a heavy chain with three CDRs comprising the amino acid sequences 809, 810, 811, respectively and a light chain with three CDRs comprising the amino acid sequences 812, 813, 814, respectively; or a heavy chain with three CDRs comprising the amino acid sequences 815, 816, 817 respectively and a light chain with three CDRs comprising the amino acid sequences 818, 819, 820 respectively; or a heavy chain with three CDRs comprising the amino acid sequences 827, 828, 829 respectively and a light chain with three CDRs comprising the amino acid sequences 830, 831, 832 respectively; or a heavy chain with three CDRs comprising the amino acid sequences 833, 834, 835, respectively and a light chain with three CDRs comprising the amino acid sequences 836, 837, 838, respectively; or a heavy chain with three CDRs comprising the amino acid sequences 839, 840, 841 respectively and a light chain with three CDRs comprising the amino acid sequences 842, 843, 844 respectively.

Carbonic Anhydrase IX (40)

Exemplary anti-CA IX antibodies include antibodies having containing a vh amino acid sequence having SEQ ID NO: 845 and a vl amino acid sequence having SEQ ID NO: 846; a VH amino acid sequence having SEQ ID NO: 847 and a VL amino acid sequence having SEQ ID NO: 868; a VH amino acid sequence having SEQ ID NO: 848 and a VL amino acid sequence having SEQ ID NO: 869; a VH amino acid sequence having SEQ ID NO: 849 and a VL amino acid sequence having SEQ ID NO: 870; a VH amino acid sequence having SEQ ID NO: 850 and a VL amino acid sequence having SEQ ID NO: 871; a VH amino acid sequence having SEQ ID NO: 851 and a VL amino acid sequence having SEQ ID NO: 872; a VH amino acid sequence having SEQ ID NO: 852 and a VL amino acid sequence having SEQ ID NO: 873; a VH amino acid sequence having SEQ ID NO: 853 and a VL amino acid sequence having SEQ ID NO: 874; a VH amino acid sequence having SEQ ID NO: 854 and a VL amino acid sequence having SEQ ID NO: 875; a VH amino acid sequence having SEQ ID NO: 855 and a VL amino acid sequence having SEQ ID NO: 876; a VH amino acid sequence having SEQ ID NO: 856 and a VL amino acid sequence having SEQ ID NO: 877; a VH amino acid sequence having SEQ ID NO: 857 and a VL amino acid sequence having SEQ ID NO: 878; a VH amino acid sequence having SEQ ID NO: 858 and a VL amino acid sequence having SEQ ID NO: 879; a VH amino acid sequence having SEQ ID NO: 859 and a VL amino acid sequence having SEQ ID NO: 880; a VH amino acid sequence having SEQ ID NO: 860 and a VL amino acid sequence having SEQ ID NO: 881; a VH amino acid sequence having SEQ ID NO: 861 and a VL amino acid sequence having SEQ ID NO: 882 a VH amino acid sequence having SEQ ID NO: 862 and a VL amino acid sequence having SEQ ID NO: 883; a VH amino acid sequence having SEQ ID NO: 863 and a VL amino acid sequence having SEQ ID NO: 884; a VH amino acid sequence having SEQ ID NO: 864 and a VL amino acid sequence having SEQ ID NO: 885; a VH amino acid sequence having SEQ ID NO: 865 and a VL amino acid sequence having SEQ ID NO: 886; a VH amino acid sequence having SEQ ID NO: 866 and a VL amino acid sequence having SEQ ID NO: 887; a VH amino acid sequence having SEQ ID NO: 867 and a VL amino acid sequence having SEQ ID NO: 888.

In other embodiments the anti-CA IX antibodies have a heavy chain with three CDRs including the amino acid sequences SEQ ID NO: 803, 804, 805 respectively and a light chain with three CDRs including the amino acid sequences 806, 807, 808 respectively; or a heavy chain with three CDRs comprising the amino acid sequences 899, 915, 909 and a light chain with three CDRs comprising the amino acid sequences 905, 906, 952 or a heavy chain with three CDRs comprising the amino acid sequences 899, 915, 909 and a light chain with three CDRs comprising the amino acid sequences 935, 943, 953 or a heavy chain with three CDRs comprising the amino acid sequences 899, 915, 909 and a light chain with three CDRs comprising the amino acid sequences 935, 906, 954 or a heavy chain with three CDRs comprising the amino acid sequences 910, 916, 923 and a light chain with three CDRs comprising the amino acid sequences 936, 944, 955 or a heavy chain with three CDRs comprising the amino acid sequences 899, 915, 909 and a light chain with three CDRs comprising the amino acid sequences 936, 944, 956 or a heavy chain with three CDRs comprising the amino acid sequences 911, 917, 924 and a light chain with three CDRs comprising the amino acid sequences 937, 945, 957 or a heavy chain with three CDRs comprising the amino acid sequences 899, 915, 909 and a light chain with three CDRs comprising the amino acid sequences 935, 946, 958 or a heavy chain with three CDRs comprising the amino acid sequences 899, 915, 909 and a light chain with three CDRs comprising the amino acid sequences 938, 946, 959 or a heavy chain with three CDRs comprising the amino acid sequences 899, 915, 909 and a light chain with three CDRs comprising the amino acid sequences 905, 946, 960 or a heavy chain with three CDRs comprising the amino acid sequences 899, 918, 925 and a light chain with three CDRs comprising the amino acid sequences 937, 947, 955 or a heavy chain with three CDRs comprising the amino acid sequences 899, 918, 926 and a light chain with three CDRs comprising the amino acid sequences 937, 945, 957 or a heavy chain with three CDRs comprising the amino acid sequences 912, 919, 927 and a light chain with three CDRs comprising the amino acid sequences 937, 943, 961 or a heavy chain with three CDRs comprising the amino acid sequences 899, 918, 928 and a light chain with three CDRs comprising the amino acid sequences 937, 906, 960 or a heavy chain with three CDRs comprising the amino acid sequences 899, 918, 928 and a light chain with three CDRs comprising the amino acid sequences 937, 906, 960 or a heavy chain with three CDRs comprising the amino acid sequences 913, 920, 929 and a light chain with three CDRs comprising the amino acid sequences 939, 948, 962 or a heavy chain with three CDRs comprising the amino acid sequences 899, 918, 930 and a light chain with three CDRs comprising the amino acid sequences 935, 944, 955 or a heavy chain with three CDRs comprising the amino acid sequences 899, 921, 931 and a light chain with three CDRs comprising the amino acid sequences 935, 944, 955 or a heavy chain with three CDRs comprising the amino acid sequences 912, 919, 932 and a light chain with three CDRs comprising the amino acid sequences 940, 949, 963 or a heavy chain with three CDRs comprising the amino acid sequences 899, 915, 909 and a light chain with three CDRs comprising the amino acid sequences 935, 943, 960 or a heavy chain with three CDRs comprising the amino acid sequences 914, 922, 933 and a light chain with three CDRs comprising the amino acid sequences 941, 950, 964 or a heavy chain with three CDRs comprising the amino acid sequences 912, 918, 934 and a light chain with three CDRs comprising the amino acid sequences 942, 951, 965.

CC-Chemokine Receptor 4 (CCR4) (048)

Exemplary CC-chemokine receptor 4 (CCR4) antibodies include antibodies having containing a VH nucleotide sequence having SEQ ID NO: 969 and a VL nucleotide sequence having SEQ ID NO: 971; a VH nucleotide sequence having SEQ ID NO: 969 and a $V_L$ nucleotide sequence having SEQ ID NO: 972.

Exemplary CCR4 antibodies include antibodies having containing a VH amino acid sequence having SEQ ID NO: 970 and a VL amino acid sequence having SEQ ID NO: 971.

In other embodiments the CCR4 antibodies have a heavy chain with three CDRs including the amino acid sequences SEQ ID NO: 973, 974, 975 respectively and a light chain with three CDRs including the amino acid sequences 976, 977, 978 respectively.

Middle East Respiratory Syndrome Coronavirus (MERS-COV). (85)

Exemplary anti-Middle East Respiratory Syndrome coronavirus (MERS-CoV) antibody include antibodies having a VH nucleotide sequence having SEQ ID NO: 677 and a VL nucleotide sequence having SEQ ID NO:679; a VH nucleotide sequence having SEQ ID NO: 681 and a VL nucleotide sequence having SEQ ID NO:683; a VH nucleotide sequence having SEQ ID NO: 685 and a VL nucleotide sequence having SEQ ID NO:687; a VH nucleotide sequence having SEQ ID NO: 689 and a VL nucleotide sequence having SEQ ID NO:692; a VH nucleotide sequence having SEQ ID NO: 693 and a VL nucleotide sequence having SEQ ID NO:695; a VH nucleotide sequence having SEQ ID NO: 697 and a VL nucleotide sequence having SEQ ID NO:699; and a VH nucleotide sequence having SEQ ID NO: 701 and a VL nucleotide sequence having SEQ ID NO:703.

Exemplary anti-Middle East Respiratory Syndrome coronavirus (MERS-CoV) antibody include antibodies having a VH amino acid sequence SEQ ID NO: 678 and a VL amino acid sequence having SEQ ID NO: 680; a VH amino acid sequence SEQ ID NO: 682 and a VL amino acid sequence having SEQ ID NO: 684; a VH amino acid sequence SEQ ID NO: 686 and a VL amino acid sequence having SEQ ID NO: 688; a VH amino acid sequence SEQ ID NO: 690 and a VL amino acid sequence having SEQ ID NO: 692; a VH amino acid sequence SEQ ID NO: 694 and a VL amino acid sequence having SEQ ID NO: 696; a VH amino acid sequence SEQ ID NO: 698 and a VL amino acid sequence having SEQ ID NO: 700; and a VH amino acid sequence SEQ ID NO: 702 and a VL amino acid sequence having SEQ ID NO: 704.

In other embodiments the anti-Middle East Respiratory Syndrome coronavirus (MERS-CoV) antibody has a heavy chain with three CDRs including the amino acid sequences of 705, 706, and 707 and a light chain with three CDRs including the amino acid sequences 722, 723, and 724; a heavy chain with three CDRs including the amino acid sequences of 708, 709, and 710 and a light chain with three CDRs including the amino acid sequences 725, 726, and 727; a heavy chain with three CDRs including the amino acid sequences of 711, 712, and 713 and a light chain with three CDRs including the amino acid sequences 728, 729, and 730; a heavy chain with three CDRs including the amino acid sequences of 711, 735, and 715 and a light chain with three CDRs including the amino acid sequences 731, 732, and 733; a heavy chain with three CDRs including the amino acid sequences of 711, 735, and 716 and a light chain with three CDRs including the amino acid sequences 737, 738, and 739; a heavy chain with three CDRs including the amino acid sequences of 717, 718, and 719 and a light chain with three CDRs including the amino acid sequences 736, 742, and 743; and a heavy chain with three CDRs including the amino acid sequences of 714, 720, and 721 and a light chain with three CDRs including the amino acid sequences 740, 729, and 741.

GITR (93)

Exemplary anti-human GITR antibody include antibodies having a VH nucleotide sequence having SEQ ID NO: 1361 and a VL nucleotide sequence having SEQ ID NO: 1363; a VH nucleotide sequence having SEQ ID NO: 1365 and a VL nucleotide sequence having SEQ ID NO:1367; a VH nucleotide sequence having SEQ ID NO: 1369 and a VL nucleotide sequence having SEQ ID NO: 1371; a VH nucleotide sequence having SEQ ID NO: 1381 and a VL nucleotide sequence having SEQ ID NO: 1375; a VH nucleotide sequence having SEQ ID NO: 1377 and a VL nucleotide sequence having SEQ ID NO: 1379; a VH nucleotide sequence having SEQ ID NO: 1381 and a VL nucleotide sequence having SEQ ID NO: 1383; a VH nucleotide sequence having SEQ ID NO: 1385 and a VL nucleotide sequence having SEQ ID NO: 1387; a VH nucleotide sequence having SEQ ID NO: 1389 and a VL nucleotide sequence having SEQ ID NO:1391; a VH nucleotide sequence having SEQ ID NO: 1393 and a VL nucleotide sequence having SEQ ID NO: 1395; a VH nucleotide sequence having SEQ ID NO: 1397 and a VL nucleotide sequence having SEQ ID NO: 1398; or a VH nucleotide sequence having SEQ ID NO: 1401and a VL nucleotide sequence having SEQ ID NO: 1403.

Exemplary anti-human GITR antibody include antibodies having a VH amino acid sequence having SEQ ID NO: 1362 and a VL amino acid sequence having SEQ ID NO: 1364; a VH amino acid having SEQ ID NO: 1366 and a VL polypeptide sequence having SEQ ID NO:1368; a VH amino acid sequence having SEQ ID NO: 1371 and a VL amino acid sequence having SEQ ID NO: 1372; a VH amino acid sequence having SEQ ID NO: 1382 and a VL amino acid sequence having SEQ ID NO: 1376; a VH nucleotide sequence having SEQ ID NO: 1378 and a VL nucleotide sequence having SEQ ID NO: 1380; a VH amino acid having SEQ ID NO: 1382 and a VL polypeptide sequence having SEQ ID NO: 1384; a VH amino acid sequence having SEQ ID NO: 1386 and a VL amino acid sequence having SEQ ID NO: 1388; a VH amino acid sequence having SEQ ID NO: 1390 and a VL amino acid sequence having SEQ ID NO: 1392; a VH amino acid having SEQ ID NO: 1394 and a VL polypeptide sequence having SEQ ID NO: 1396; a VH amino acid sequence having SEQ ID NO: 1399 and a VL amino acid sequence having SEQ ID NO: 1400; or a VH amino acid sequence having SEQ ID NO: 1402 and a VL amino acid sequence having SEQ ID NO: 1404.

In other embodiments the anti-human GITR antibody has a heavy chain with three CDRs including the amino acid sequences 1405, 1406, and 1407 and a light chain with three CDRs including the amino acid sequences 1408, 1409, and 1410 respectively; a heavy chain with three CDRs including the amino acid sequences 1411, 1412, and 1413 and a light chain with three CDRs including the amino acid sequences 1414, 1415, and 1416 respectively; a heavy chain with three CDRs including the amino acid sequences 1417, 1418, and 1419 and a light chain with three CDRs including the amino acid sequences 1420, 1421, and 1422 respectively; a heavy chain with three CDRs including the amino acid sequences 1423, 1424, and 1425 and a light chain with three CDRs including the amino acid sequences 1426, 1427, and 1428 respectively; a heavy chain with three CDRs including the amino acid sequences 1429, 1430, and 1431 and a light chain with three CDRs including the amino acid sequences 1432, 1433, and 1434 respectively; a heavy chain with three CDRs including the amino acid sequences 1435, 1436, and 1437 and a light chain with three CDRs including the amino acid sequences 1438, 1439, and 1440 respectively; a heavy chain with three CDRs including the amino acid sequences 1441, 1442, and 1443 and a light chain with three CDRs including the amino acid sequences 1444, 1445, and 1446 respectively; a heavy chain with three CDRs including the amino acid sequences 1447, 1448, and 1449 and a light chain with three CDRs including the amino acid sequences 1450, 1451, and 1452 respectively; a heavy chain with three CDRs including the amino acid sequences 1453, 1454, and 1455 and a light chain with three CDRs including the amino acid sequences 1456, 1457, and 1458 respectively; a heavy chain with three CDRs including the amino acid sequences 1459, 1460, and 1461 and a light chain with three CDRs including the amino acid sequences 1462, 1463, and 1464 respectively; or a heavy chain with three CDRs including the amino acid sequences 1465, 1466, and 1467 and a light chain with three CDRs including the amino acid sequences 1468, 1469, and 1470 respectively.

Flavivirus (73)

Exemplary anti-West Nile virus envelope protein E (WNE) antibody include antibodies having a VH nucleotide sequence having a VH amino acid sequence having SEQ ID NO: 1224 and a VL amino acid sequence having SEQ ID NO: 1226.

Exemplary anti-West Nile virus envelope protein E (WNE) antibody include antibodies having a VH nucleotide sequence having SEQ ID NO: 1225 and a VL nucleotide sequence having SEQ ID NO: 1227.

In other embodiments the anti-West Nile virus envelope protein E (WNE) antibody has a heavy chain with three CDRs including the amino acid sequences 1244, 1245, and 1246 and a light chain with three CDRs including the amino acid sequences 1247, 1248, and 1249 respectively.

CCR4 (65)

Exemplary anti-CC-chemokine receptor 4 (CCR4) antibody include antibodies having a $v_H$ nucleotide sequence having SEQ ID NO: 1329 and a $v_L$ nucleotide sequence having SEQ ID NO: 1331; a $v_H$ nucleotide sequence having SEQ ID NO: 1333 and a $V_L$ nucleotide sequence having SEQ ID NO:1335; a $v_H$ nucleotide sequence having SEQ ID NO: 1337 and a $V_L$ nucleotide sequence having SEQ ID NO: 1192; a $v_H$ nucleotide sequence having SEQ ID NO: 1341 and a $v_L$ nucleotide sequence having SEQ ID NO: 1343; or a $v_H$ nucleotide sequence having SEQ ID NO: 1357 and a $v_L$ nucleotide sequence having SEQ ID NO:1359.

Exemplary anti-CC-chemokine receptor 4 (CCR4) antibody include antibodies having a $V_H$ amino acid sequence having SEQ ID NO: 1330 and a $V_L$ amino acid sequence having SEQ ID NO: 1332; a $V_H$ amino acid sequence having SEQ ID NO: 1334 and a V_L amino acid sequence having SEQ ID NO: 1336; a V_H amino acid sequence having SEQ ID NO: 1338 and a V_L amino acid sequence having SEQ ID NO: 1340; a V_H amino acid sequence having SEQ ID NO: 1342 and a V_L amino acid sequence having SEQ ID NO: 1344; or a V_H amino acid sequence having SEQ ID NO: 1358 and a V_L amino acid sequence having SEQ ID NO: 1360.

In other embodiments the anti-CC-chemokine receptor 4 (CCR4) antibody has a heavy chain with three CDRs including the amino acid sequences 1203, 1208, and 1211 and a light chain with three CDRs including the amino acid sequences 1207, 1209, and 1216 respectively; or a heavy chain with three CDRs including the amino acid sequences 1204, 1208, and 1212 and a light chain with three CDRs including the amino acid sequences 1207, 1209, and 1217 respectively; or a heavy chain with three CDRs including the amino acid sequences 1204, 1208, and 1213 and a light chain with three CDRs including the amino acid sequences 1207, 1209, and 1217 respectively; or a heavy chain with three CDRs including the amino acid sequences 1205, 1208, and 1214 and a light chain with three CDRs including the amino acid sequences 1207, 1209, and 1218 respectively; or a heavy chain with three CDRs including the amino acid sequences 1206, 1208, and 1210 and a light chain with three CDRs including the amino acid sequences 1207, 1209, and 1220 respectively; or a heavy chain with three CDRs including the amino acid sequences 1202, 1208, and 1210 and a light chain with three CDRs including the amino acid sequences 1207, 1209, and 1219 respectively.

Human Immunoglobulin Heavy Chain Variable Region Germline Gene VH1-69 (57)

Exemplary anti-human immunoglobulin heavy chain variable region germline gene VH1-69 antibody include antibodies having a VH nucleotide sequence having SEQ ID NO: 1153 and a VL nucleotide sequence having SEQ ID NO: 1155; or a VH nucleotide sequence having SEQ ID NO: 1163 and a VL nucleotide sequence having SEQ ID NO:1155.

Exemplary anti-human immunoglobulin heavy chain variable region germline gene VH1-69 antibody include antibodies having a V_H amino acid sequence having SEQ ID NO: 1154 and a V_L amino acid sequence having SEQ ID NO: 1156; or a V_H amino acid sequence having SEQ ID NO: 1164 and a V_L amino acid sequence having SEQ ID NO: 1156.

In other embodiments the anti-human immunoglobulin heavy chain variable region germline gene VH1-69 antibody has a heavy chain with three CDRs including the amino acid sequences 1157, 1158, and 1159 and a light chain with three CDRs including the amino acid sequences 1160, 1161, and 1162 respectively.

Influenza (49)

Exemplary anti-influenza antibody include antibodies having a VH nucleotide sequence having SEQ ID NO: 981 and a VL nucleotide sequence having SEQ ID NO: 983; a VH nucleotide sequence having SEQ ID NO: 985 and a VL nucleotide sequence having SEQ ID NO: 989; a VH nucleotide sequence having SEQ ID NO: 987 and a VL nucleotide sequence having SEQ ID NO: 991; a VH nucleotide sequence having SEQ ID NO: 993 and a VL nucleotide sequence having SEQ ID NO: 997; a VH nucleotide sequence having SEQ ID NO: 995 and a VK nucleotide sequence having SEQ ID NO: 999; a VH nucleotide sequence having SEQ ID NO: 1001 and a VL nucleotide sequence having SEQ ID NO: 1005; a VH nucleotide sequence having SEQ ID NO: 1003 and a VL nucleotide sequence having SEQ ID NO: 1007; a VH nucleotide sequence having SEQ ID NO: 1009 and a VL nucleotide sequence having SEQ ID NO: 1011; a VH nucleotide sequence having SEQ ID NO: 1013 and a VL nucleotide sequence having SEQ ID NO: 1015; and a VH nucleotide sequence having SEQ ID NO: 1017 and a VK nucleotide sequence having SEQ ID NO: 1019; a VH nucleotide sequence having SEQ ID NO: 1020 and a VL nucleotide sequence having SEQ ID NO: 1022.

Exemplary anti-influenza antibody include antibodies having a VH amino acid sequence having SEQ ID NO: 982 and a VL amino acid sequence having SEQ ID NO: 984; a VH amino acid sequence having SEQ ID NO: 986 and a VL amino acid sequence having SEQ ID NO: 988; a VH amino acid sequence having SEQ ID NO: 986 and a VL amino acid sequence having SEQ ID NO: 990; a VH amino acid sequence having SEQ ID NO: 992 and a VL amino acid sequence having SEQ ID NO: 994; a VH amino acid sequence having SEQ ID NO: 992 and a VK amino acid sequence having SEQ ID NO: 996; a VH amino acid sequence having SEQ ID NO: 998 and a VL amino acid sequence having SEQ ID NO: 1000; a VH amino acid sequence having SEQ ID NO: 998 and a VL amino acid sequence having SEQ ID NO: 1002; a VH amino acid sequence having SEQ ID NO: 1004 and a VL amino acid sequence having SEQ ID NO: 1006; a VH amino acid sequence having SEQ ID NO: 1008 and a VL amino acid sequence having SEQ ID NO: 1010; a VH amino acid sequence having SEQ ID NO: 1012 and a VK amino acid sequence having SEQ ID NO: 1014; and a VH amino acid sequence having SEQ ID NO: 1016 and a VL amino acid sequence having SEQ ID NO: 1018.

In other embodiments the anti-influenza antibody has a heavy chain with three CDRs including the amino acid sequences of 1023, 1031, and 1039 and a light chain with three CDRs including the amino acid sequences 1047, 1059, and 1071; a heavy chain with three CDRs including the amino acid sequences of 1023, 1032, and 1040 and a light chain with three CDRs including the amino acid sequences 1048, 1060, and 1072; a heavy chain with three CDRs including the amino acid sequences of 1025, 1032, and 1040 and a light chain with three CDRs including the amino acid sequences 1057, 1069, and 1081; a heavy chain with three CDRs including the amino acid sequences of 1026, 1033, and 1041 and a light chain with three CDRs including the amino acid sequences 1049, 1061, and 1073; a heavy chain with three CDRs including the amino acid sequences of 1026, 1033, and 1041 and a light chain with three CDRs including the amino acid sequences 1054, 1066, and 1078; a heavy chain with three CDRs including the amino acid sequences of 1027, 1034, and 1042 and a light chain with three CDRs including the amino acid sequences 1050, 1062, and 1074; a heavy chain with three CDRs including the amino acid sequences of 1027, 1034, and 1042 and a light chain with three CDRs including the amino acid sequences 1056, 1068, and 1080; a heavy chain with three CDRs including the amino acid sequences of 1028, 1035, and 1043 and a light chain with three CDRs including the amino acid sequences 1051, 1063, and 1065; a heavy chain with three CDRs including the amino acid sequences of 1028, 1036, and 1044 and a light chain with three CDRs including the amino acid sequences 1052, 1064, and 1076; a heavy chain with three CDRs including the amino acid sequences of 1029, 1037, and 1045 and a light chain with three CDRs including the amino acid sequences 1053, 1065, and 1077; or a heavy chain with three CDRs including the amino acid sequences of 1030, 1038, and 1046 and a light chain with three CDRs including the amino acid sequences 1058, 1070, and 1082.

Influenza (78)

Exemplary anti-influenza antibodies include antibodies having containing a VH nucleotide sequence having SEQ ID NO: 397 and a VL nucleotide sequence having SEQ ID NO: 398; a VH nucleotide sequence having SEQ ID NO: 399 and a $V_L$ nucleotide sequence having SEQ ID NO:400; a VH nucleotide sequence having SEQ ID NO: 401 and a $V_L$ nucleotide sequence having SEQ ID NO: 402; a VH nucleotide sequence having SEQ ID NO: 403 and a VL nucleotide sequence having SEQ ID NO: 404; or a VH nucleotide sequence having SEQ ID NO: 405 and a VL nucleotide sequence having SEQ ID NO:406; or a VH nucleotide sequence having SEQ ID NO: 407 and a VL nucleotide sequence having SEQ ID NO:408; or a VH nucleotide sequence having SEQ ID NO: 409 and a VL nucleotide sequence having SEQ ID NO:410; or a VH nucleotide sequence having SEQ ID NO: 411 and a VL nucleotide sequence having SEQ ID NO:412; or a VH nucleotide sequence having SEQ ID NO: 413 and a VL nucleotide sequence having SEQ ID NO:414; or a VH nucleotide sequence having SEQ ID NO: 415 and a VL nucleotide sequence having SEQ ID NO:416; or a VH nucleotide sequence having SEQ ID NO: 417 and a VL nucleotide sequence having SEQ ID NO:418; or a VH nucleotide sequence having SEQ ID NO: 419 and a VL nucleotide sequence having SEQ ID NO:420; or a VH nucleotide sequence having SEQ ID NO: 421 and a VL nucleotide sequence having SEQ ID NO:422; or a VH nucleotide sequence having SEQ ID NO: 423 and a VL nucleotide sequence having SEQ ID NO:424; or a VH nucleotide sequence having SEQ ID NO: 425 and a VL nucleotide sequence having SEQ ID NO:426; or a VH nucleotide sequence having SEQ ID NO: 427 and a VL nucleotide sequence having SEQ ID NO:428; or a VH nucleotide sequence having SEQ ID NO: 429 and a VL nucleotide sequence having SEQ ID NO:430; or a VH nucleotide sequence having SEQ ID NO: 431 and a VL nucleotide sequence having SEQ ID NO:432; or a VH nucleotide sequence having SEQ ID NO: 433 and a VL nucleotide sequence having SEQ ID NO:434; or a VH nucleotide sequence having SEQ ID NO: 435 and a VL nucleotide sequence having SEQ ID NO:436; or a VH nucleotide sequence having SEQ ID NO: 437 and a VL nucleotide sequence having SEQ ID NO:438; or a VH nucleotide sequence having SEQ ID NO: 439 and a VL nucleotide sequence having SEQ ID NO:440; or a VH nucleotide sequence having SEQ ID NO: 441 and a VL nucleotide sequence having SEQ ID NO:442; or a VH nucleotide sequence having SEQ ID NO: 541 and a VL nucleotide sequence having SEQ ID NO: 542; or a VH nucleotide sequence having SEQ ID NO: 543 and a VL nucleotide sequence having SEQ ID NO: 544; or a VH nucleotide sequence having SEQ ID NO: 545 and a VL nucleotide sequence having SEQ ID NO: 546; or a VH nucleotide sequence having SEQ ID NO: 547 and a VL nucleotide sequence having SEQ ID NO: 548; or a VH nucleotide sequence having SEQ ID NO: 549 and a VL nucleotide sequence having SEQ ID NO: 550; or a VH nucleotide sequence having SEQ ID NO: 551 and a VL nucleotide sequence having SEQ ID NO: 552; or a VH nucleotide sequence having SEQ ID NO: 553 and a VL nucleotide sequence having SEQ ID NO: 554; or a VH nucleotide sequence having SEQ ID NO: 555 and a VL nucleotide sequence having SEQ ID NO: 556; or a VH nucleotide sequence having SEQ ID NO: 557 and a VL nucleotide sequence having SEQ ID NO: 558; or a VH nucleotide sequence having SEQ ID NO: 559 and a VL nucleotide sequence having SEQ ID NO: 560; or a VH nucleotide sequence having SEQ ID NO: 561 and a VL nucleotide sequence having SEQ ID NO: 562; or a VH nucleotide sequence having SEQ ID NO: 563 and a VL nucleotide sequence having SEQ ID NO: 564; or a VH nucleotide sequence having SEQ ID NO: 565 and a VL nucleotide sequence having SEQ ID NO: 566; or a VH nucleotide sequence having SEQ ID NO: 567 and a VL nucleotide sequence having SEQ ID NO: 568; or a VH nucleotide sequence having SEQ ID NO: 569 and a VL nucleotide sequence having SEQ ID NO: 570; or a VH nucleotide sequence having SEQ ID NO: 571 and a VL nucleotide sequence having SEQ ID NO: 572; or a VH nucleotide sequence having SEQ ID NO: 573 and a VL nucleotide sequence having SEQ ID NO: 574; or a VH nucleotide sequence having SEQ ID NO: 575 and a VL nucleotide sequence having SEQ ID NO: 576; or a VH nucleotide sequence having SEQ ID NO: 577 and a VL nucleotide sequence having SEQ ID NO: 578; or a VH nucleotide sequence having SEQ ID NO: 579 and a VL nucleotide sequence having SEQ ID NO: 580; or a VH nucleotide sequence having SEQ ID NO: 581 and a VL nucleotide sequence having SEQ ID NO: 582; or a VH nucleotide sequence having SEQ ID NO: 583 and a VL nucleotide sequence having SEQ ID NO: 584; or a VH nucleotide sequence having SEQ ID NO: 585 and a VL nucleotide sequence having SEQ ID NO: 586; or a VH nucleotide sequence having SEQ ID NO: 587 and a VL nucleotide sequence having SEQ ID NO: 588; or a VH nucleotide sequence having SEQ ID NO: 589 and a VL nucleotide sequence having SEQ ID NO: 590; or a VH nucleotide sequence having SEQ ID NO: 591 and a VL nucleotide sequence having SEQ ID NO: 592; or a VH nucleotide sequence having SEQ ID NO: 593 and a VL nucleotide sequence having SEQ ID NO: 594; or a VH nucleotide sequence having SEQ ID NO: 595 and a VL nucleotide sequence having SEQ ID NO: 596; or a VH nucleotide sequence having SEQ ID NO: 597 and a VL nucleotide sequence having SEQ ID NO: 598; or a VH nucleotide sequence having SEQ ID NO: 599 and a VL nucleotide sequence having SEQ ID NO: 600.

Exemplary anti-influenza antibodies antibody include antibodies having containing a VH amino acid sequence having SEQ ID NO: 469 and a VL amino acid sequence having SEQ ID NO: 470; a VH amino acid having SEQ ID NO: 471 and a $V_L$ polypeptide sequence having SEQ ID NO:472; a VH amino acid sequence having SEQ ID NO: 473 and a $V_L$ amino acid sequence having SEQ ID NO: 474; a VH amino acid sequence having SEQ ID NO: 475 and a VL amino acid sequence having SEQ ID NO: 476; or a VH nucleotide sequence having SEQ ID NO: 477 and a VL nucleotide sequence having SEQ ID NO:478; a VH amino acid sequence having SEQ ID NO: 479 and a VL amino acid sequence having SEQ ID NO: 480; a VH amino acid sequence having SEQ ID NO: 481 and a VL amino acid sequence having SEQ ID NO: 482; a VH amino acid sequence having SEQ ID NO: 483 and a VL amino acid sequence having SEQ ID NO: 484; a VH amino acid sequence having SEQ ID NO: 485 and a VL amino acid sequence having SEQ ID NO: 486; a VH amino acid sequence having SEQ ID NO: 487 and a VL amino acid sequence having SEQ ID NO: 488; a VH amino acid sequence having SEQ ID NO: 489 and a VL amino acid sequence having SEQ ID NO: 490; a VH amino acid sequence having SEQ ID NO: 491 and a VL amino acid sequence having SEQ ID NO: 492; a VH amino acid sequence having SEQ ID NO: 493 and a VL amino acid sequence having SEQ ID NO: 494; a VH amino acid sequence having SEQ ID NO: 495 and a VL amino acid sequence having SEQ ID NO: 496; a VH amino acid sequence having SEQ ID NO: 497 and a VL amino acid sequence having SEQ ID NO: 498; a VH amino acid sequence having SEQ ID NO: 499 and a VL amino acid sequence having SEQ ID NO: 500; a VH amino acid sequence having SEQ ID NO: 501 and a VL amino acid sequence having SEQ ID NO: 502; a VH amino acid sequence having SEQ ID NO: 503 and a VL amino acid sequence having SEQ ID NO: 504; a VH amino acid sequence having SEQ ID NO: 505 and a VL amino acid sequence having SEQ ID NO: 506; a VH amino acid sequence having SEQ ID NO: 507 and a VL amino acid sequence having SEQ ID NO: 508; a VH amino acid sequence having SEQ ID NO: 509 and a VL amino acid sequence having SEQ ID NO: 510; a VH amino acid sequence having SEQ ID NO: 511 and a VL amino acid sequence having SEQ ID NO: 512; a VH amino acid sequence having SEQ ID NO: 513 and a VL amino acid sequence having SEQ ID NO: 514; a VH amino acid sequence having SEQ ID NO: 515 and a VL amino acid sequence having SEQ ID NO: 516; a VH amino acid sequence having SEQ ID NO: 517 and a VL amino acid sequence having SEQ ID NO: 518; a VH amino acid sequence having SEQ ID NO: 519 and a VL amino acid sequence having SEQ ID NO: 520; a VH amino acid sequence having SEQ ID NO: 521 and a VL amino acid sequence having SEQ ID NO: 522; a VH amino acid sequence having SEQ ID NO: 523 and a VL amino acid sequence having SEQ ID NO: 524; a VH amino acid sequence having SEQ ID NO: 525 and a VL amino acid sequence having SEQ ID NO: 526; a VH amino acid sequence having SEQ ID NO: 527 and a VL amino acid sequence having SEQ ID NO: 528; a VH amino acid sequence having SEQ ID NO: 529 and a VL amino acid sequence having SEQ ID NO: 530; a VH amino acid sequence having SEQ ID NO: 531 and a VL amino acid sequence having SEQ ID NO: 532; a VH amino acid sequence having SEQ ID NO: 533 and a VL amino acid sequence having SEQ ID NO: 534; a VH amino acid sequence having SEQ ID NO: 535 and a VL amino acid sequence having SEQ ID NO: 536; a VH amino acid sequence having SEQ ID NO: 537 and a VL amino acid sequence having SEQ ID NO: 538; a VH amino acid sequence having SEQ ID NO: 539 and a VL amino acid sequence having SEQ ID NO: 540 a VH amino acid sequence having SEQ ID NO: 601 and a VL amino acid sequence having SEQ ID NO: 602 a VH amino acid sequence having SEQ ID NO: 603 and a VL amino acid sequence having SEQ ID NO: 604 a VH amino acid sequence having SEQ ID NO: 605 and a VL amino acid sequence having SEQ ID NO: 606 a VH amino acid sequence having SEQ ID NO: 607 and a VL amino acid sequence having SEQ ID NO: 608 a VH amino acid sequence having SEQ ID NO: 609 and a VL amino acid sequence having SEQ ID NO: 610 a VH amino acid sequence having SEQ ID NO: 611 and a VL amino acid sequence having SEQ ID NO: 612 a VH amino acid sequence having SEQ ID NO: 613 and a VL amino acid sequence having SEQ ID NO: 614 a VH amino acid sequence having SEQ ID NO: 615 and a VL amino acid sequence having SEQ ID NO: 616 a VH amino acid sequence having SEQ ID NO: 617 and a VL amino acid sequence having SEQ ID NO: 618 a VH amino acid sequence having SEQ ID NO: 619 and a VL amino acid sequence having SEQ ID NO: 620 a VH amino acid sequence having SEQ ID NO: 621 and a VL amino acid sequence having SEQ ID NO: 622 a VH amino acid sequence having SEQ ID NO: 623 and a VL amino acid sequence having SEQ ID NO: 624 a VH amino acid sequence having SEQ ID NO: 625 and a VL amino acid sequence having SEQ ID NO: 626 a VH amino acid sequence having SEQ ID NO: 627 and a VL amino acid sequence having SEQ ID NO: 628 a VH amino acid sequence having SEQ ID NO: 629 and a VL amino acid sequence having SEQ ID NO: 630 a VH amino acid sequence having SEQ ID NO: 631 and a VL amino acid sequence having SEQ ID NO: 632 a VH amino acid sequence having SEQ ID NO: 633 and a VL amino acid sequence having SEQ ID NO: 634 a VH amino acid sequence having SEQ ID NO: 635 and a VL amino acid sequence having SEQ ID NO: 636 a VH amino acid sequence having SEQ ID NO: 637 and a VL amino acid sequence having SEQ ID NO: 638 a VH amino acid sequence having SEQ ID NO: 639 and a VL amino acid sequence having SEQ ID NO: 640 a VH amino acid sequence having SEQ ID NO: 641 and a VL amino acid sequence having SEQ ID NO: 642 a VH amino acid sequence having SEQ ID NO: 643 and a VL amino acid sequence having SEQ ID NO: 644 a VH amino acid sequence having SEQ ID NO: 645 and a VL amino acid sequence having SEQ ID NO: 646 a VH amino acid sequence having SEQ ID NO: 647 and a VL amino acid sequence having SEQ ID NO: 648 a VH amino acid sequence having SEQ ID NO: 649 and a VL amino acid sequence having SEQ ID NO: 650 a VH amino acid sequence having SEQ ID NO: 651 and a VL amino acid sequence having SEQ ID NO: 652 a VH amino acid sequence having SEQ ID NO: 653 and a VL amino acid sequence having SEQ ID NO: 654 a VH amino acid sequence having SEQ ID NO: 655 and a VL amino acid sequence having SEQ ID NO: 656 a VH amino acid sequence having SEQ ID NO: 657 and a VL amino acid sequence having SEQ ID NO: 658 a VH amino acid sequence having SEQ ID NO: 659 and a VL amino acid sequence having SEQ ID NO: 660.

In other embodiments the anti-influenza antibodies antibody has a heavy chain with three CDRs including the amino acid sequences SEQ ID NO: 1, 37, 73 respectively and a light chain with three CDRs including the amino acid sequences 109, 145, 181 respectively; or a heavy chain with three CDRs comprising the amino acid sequences 2, 38, 74 respectively and a light chain with three CDRs comprising the amino acid sequences 110, 146, 182, respectively; or a heavy chain with three CDRs comprising the amino acid sequences 3, 39, 75 respectively and a light chain with three CDRs comprising the amino acid sequences 111, 147, 183, respectively; or a heavy chain with three CDRs comprising the amino acid sequences 4, 40, 76 respectively and a light chain with three CDRs comprising the amino acid sequences 112, 148, 184, respectively; or a heavy chain with three CDRs comprising the amino acid sequences 5, 41, 77 respectively and a light chain with three CDRs comprising the amino acid sequences 113, 149, 185, respectively; or a heavy chain with three CDRs comprising the amino acid sequences 6, 42, 78 respectively and a light chain with three CDRs comprising the amino acid sequences 114, 150, 186, respectively; or a heavy chain with three CDRs comprising the amino acid sequences 7, 43, 79 respectively and a light chain with three CDRs comprising the amino acid sequences 115, 151, 187, respectively; or a heavy chain with three CDRs comprising the amino acid sequences 8, 44, 80 respectively and a light chain with three CDRs comprising the amino acid sequences 116, 152, 188, respectively; or a heavy chain with three CDRs comprising the amino acid sequences 9, 45, 81 respectively and a light chain with three CDRs comprising the amino acid sequences 117, 153, 189, respectively; or a heavy chain with three CDRs comprising the amino acid sequences 10, 46, 82 respectively and a light chain with three CDRs comprising the amino acid sequences 118, 154, 190, respectively; or a heavy chain with three CDRs comprising the amino acid sequences 11, 47, 83 respectively and a light chain with three CDRs comprising the amino acid sequences 119, 155, 191, respectively; or a heavy chain with three CDRs comprising the amino acid sequences 12, 48, 84 respectively and a light chain with three CDRs comprising the amino acid sequences 120, 156, 192, respectively; or a heavy chain with three CDRs comprising the amino acid sequences 13, 49, 85 respectively and a light chain with three CDRs comprising the amino acid sequences 121, 157, 193, respectively; or a heavy chain with three CDRs comprising the amino acid sequences 14, 50, 86 respectively and a light chain with three CDRs comprising the amino acid sequences 122, 158, 194, respectively; or a heavy chain with three CDRs comprising the amino acid sequences 15, 51, 87 respectively and a light chain with three CDRs comprising the amino acid sequences 123, 159, 195, respectively; or a heavy chain with three CDRs comprising the amino acid sequences 16, 52, 88 respectively and a light chain with three CDRs comprising the amino acid sequences 124, 160, 196, respectively; or a heavy chain with three CDRs comprising the amino acid sequences 17, 53, 89 respectively and a light chain with three CDRs comprising the amino acid sequences 125, 161, 197, respectively; or a heavy chain with three CDRs comprising the amino acid sequences 18, 54, 90 respectively and a light chain with three CDRs comprising the amino acid sequences 126, 162, 198, respectively; or a heavy chain with three CDRs comprising the amino acid sequences 19, 55, 91 respectively and a light chain with three CDRs comprising the amino acid sequences 127, 163, 199, respectively; or a heavy chain with three CDRs comprising the amino acid sequences 20, 56, 92 respectively and a light chain with three CDRs comprising the amino acid sequences 128, 164, 200, respectively; or a heavy chain with three CDRs comprising the amino acid sequences 21, 57, 93 respectively and a light chain with three CDRs comprising the amino acid sequences 129, 165, 201, respectively; or a heavy chain with three CDRs comprising the amino acid sequences 22, 58, 94 respectively and a light chain with three CDRs comprising the amino acid sequences 130, 166, 202, respectively; or a heavy chain with three CDRs comprising the amino acid sequences 23, 59, 95 respectively and a light chain with three CDRs comprising the amino acid sequences 131, 167, 203, respectively; or a heavy chain with three CDRs comprising the amino acid sequences 24, 60, 96 respectively and a light chain with three CDRs comprising the amino acid sequences 132, 168, 204, respectively; or a heavy chain with three CDRs comprising the amino acid sequences 25, 61, 95 respectively and a light chain with three CDRs comprising the amino acid sequences 133, 169, 205, respectively; or a heavy chain with three CDRs comprising the amino acid sequences 26, 62, 96 respectively and a light chain with three CDRs comprising the amino acid sequences 134, 170, 206, respectively; or a heavy chain with three CDRs comprising the amino acid sequences 27, 63, 97 respectively and a light chain with three CDRs comprising the amino acid sequences 135, 171, 207, respectively; or a heavy chain with three CDRs comprising the amino acid sequences 28, 64, 98 respectively and a light chain with three CDRs comprising the amino acid sequences 136, 172, 208, respectively; or a heavy chain with three CDRs comprising the amino acid sequences 29, 65, 99 respectively and a light chain with three CDRs comprising the amino acid sequences 137, 173, 209, respectively; or a heavy chain with three CDRs comprising the amino acid sequences 30, 66, 100 respectively and a light chain with three CDRs comprising the amino acid sequences 138, 174, 210, respectively; or a heavy chain with three CDRs comprising the amino acid sequences 31, 67, 101 respectively and a light chain with three CDRs comprising the amino acid sequences 139, 175, 211, respectively; or a heavy chain with three CDRs comprising the amino acid sequences 32, 68, 102 respectively and a light chain with three CDRs comprising the amino acid sequences 140, 176, 212, respectively; or a heavy chain with three CDRs comprising the amino acid sequences 33, 69, 103 respectively and a light chain with three CDRs comprising the amino acid sequences 141, 177, 213, respectively; or a heavy chain with three CDRs comprising the amino acid sequences 34, 70, 104 respectively and a light chain with three CDRs comprising the amino acid sequences 142, 178, 214, respectively; or a heavy chain with three CDRs comprising the amino acid sequences 35, 71, 105 respectively and a light chain with three CDRs comprising the amino acid sequences 143, 179, 215, respectively; or a heavy chain with three CDRs comprising the amino acid sequences 36, 72, 106 respectively and a light chain with three CDRs comprising the amino acid sequences 144, 180, 216, respectively; or a heavy chain with three CDRs comprising the amino acid sequences 217, 247, 277 respectively and a light chain with three CDRs comprising the amino acid sequences 307, 337, 367, respectively; or a heavy chain with three CDRs comprising the amino acid sequences 218, 248, 278 respectively and a light chain with three CDRs comprising the amino acid sequences 308, 338, 368, respectively; or a heavy chain with three CDRs comprising the amino acid sequences 219, 249, 279 respectively and a light chain with three CDRs comprising the amino acid sequences 309, 339, 369, respectively; or a heavy chain with three CDRs comprising the amino acid sequences 220, 250, 280 respectively and a light chain with three CDRs comprising the amino acid sequences 310, 340, 370, respectively; or a heavy chain with three CDRs comprising the amino acid sequences 221, 251, 281 respectively and a light chain with three CDRs comprising the amino acid sequences 311, 341, 371, respectively; or a heavy chain with three CDRs comprising the amino acid sequences 222, 252, 282 respectively and a light chain with three CDRs comprising the amino acid sequences 312, 342, 372, respectively; or a heavy chain with three CDRs comprising the amino acid sequences 223, 253, 283 respectively and a light chain with three CDRs comprising the amino acid sequences 313, 343, 373, respectively; or a heavy chain with three CDRs comprising the amino acid sequences 224, 254, 284 respectively and a light chain with three CDRs comprising the amino acid sequences 314, 344, 374, respectively; or a heavy chain with three CDRs comprising the amino acid sequences 225, 255, 285 respectively and a light chain with three CDRs comprising the amino acid sequences 315, 345, 375, respectively; or a heavy chain with three CDRs comprising the amino acid sequences 226, 256, 286 respectively and a light chain with three CDRs comprising the amino acid sequences 316, 346, 376, respectively; or a heavy chain with three CDRs comprising the amino acid sequences 227, 257, 287 respectively and a light chain with three CDRs comprising the amino acid sequences 317, 347, 377, respectively; or a heavy chain with three CDRs comprising the amino acid sequences 228, 258, 288 respectively and a light chain with three CDRs comprising the amino acid sequences 318, 348, 378, respectively; or a heavy chain with three CDRs comprising the amino acid sequences 229, 259, 289 respectively and a light chain with three CDRs comprising the amino acid sequences 319, 349, 379, respectively; or a heavy chain with three CDRs comprising the amino acid sequences 230, 260, 290 respectively and a light chain with three CDRs comprising the amino acid sequences 320, 350, 380, respectively; or a heavy chain with three CDRs comprising the amino acid sequences 231, 261, 291 respectively and a light chain with three CDRs comprising the amino acid sequences 321, 351, 381, respectively; or a heavy chain with three CDRs comprising the amino acid sequences 232, 262, 292 respectively and a light chain with three CDRs comprising the amino acid sequences 322, 352, 382, respectively; or a heavy chain with three CDRs comprising the amino acid sequences 233, 263, 293 respectively and a light chain with three CDRs comprising the amino acid sequences 323, 353, 383, respectively; or a heavy chain with three CDRs comprising the amino acid sequences 234, 273, 294 respectively and a light chain with three CDRs comprising the amino acid sequences 324, 354, 384, respectively; or a heavy chain with three CDRs comprising the amino acid sequences 235, 274, 295 respectively and a light chain with three CDRs comprising the amino acid sequences 325, 355, 385, respectively; or a heavy chain with three CDRs comprising the amino acid sequences 236, 275, 296 respectively and a light chain with three CDRs comprising the amino acid sequences 326, 356, 386, respectively; or a heavy chain with three CDRs comprising the amino acid sequences 237, 276, 297 respectively and a light chain with three CDRs comprising the amino acid sequences 327, 357, 387, respectively; or a heavy chain with three CDRs comprising the amino acid sequences 237, 277, 298 respectively and a light chain with three CDRs comprising the amino acid sequences 328, 358, 388, respectively; or a heavy chain with three CDRs comprising the amino acid sequences 238, 278, 299 respectively and a light chain with three CDRs comprising the amino acid sequences 329, 359, 389, respectively; or a heavy chain with three CDRs comprising the amino acid sequences 239, 279, 300 respectively and a light chain with three CDRs comprising the amino acid sequences 330, 360, 390, respectively; or a heavy chain with three CDRs comprising the amino acid sequences 240, 280, 301 respectively and a light chain with three CDRs comprising the amino acid sequences 331, 361, 391, respectively; or a heavy chain with three CDRs comprising the amino acid sequences 241, 281, 302 respectively and a light chain with three CDRs comprising the amino acid sequences 332, 362, 392, respectively; or a heavy chain with three CDRs comprising the amino acid sequences 242, 282, 303 respectively and a light chain with three CDRs comprising the amino acid sequences 333, 363, 393, respectively; or a heavy chain with three CDRs comprising the amino acid sequences 243, 283, 304 respectively and a light chain with three CDRs comprising the amino acid sequences 334, 364, 394, respectively; or a heavy chain with three CDRs comprising the amino acid sequences 244, 284, 305 respectively and a light chain with three CDRs comprising the amino acid sequences 335, 365, 395, respectively; or a heavy chain with three CDRs comprising the amino acid sequences 245, 285, 306 respectively and a light chain with three CDRs comprising the amino acid sequences 336, 366, 396, respectively.

Other anti-influenza antibodies include those having the amino acid or nucleic acid sequences shown in the below Table 1.

TABLE 1A

Antibody 3I14 Variable Region nucleic acid sequences $V_H$ chain of 3I14 (SEQ ID NO: 1665)
CAGGTGCAGCTGTTGGAGTCTGGGGGAGGCGTGGTCCAGCCTGGGAGGTCCCTGAGACTCTCCTGT
GCAGCCTCTGGATTCACCTTCAGTAACTATGGCATGCACTGGGTCCGCCAGGCTCCAGGCAAGGGG
CTGGAGTGGGTGGCAATTATATCATTTGATGGAAGTAAAAAATATTATGCAAACTCCGTGAAGGGC
CGATCCACCATCTCCAGAGACAATTCCAAGAACACGCTGTCTCTGCAAATGAACAGCCTGGGACCT
GAGGACACGGCTCTATATTACTGTGCGAAACTGCCCTCCCCGTATTACTTTGATAGTCGGTTCGTG
TGGGTCGCCGCCAGCGCATTTCACTTCTGGGGCCAGGGAATCCTGGTCACCGTCTCTTCA $V_L$ chain of 3I14 (SEQ ID NO: 1667)
AATTTTATGCTGACTCAGCCACCCTCAGCGTCTGGGACCCCCGGGCAGAGGGTCACCATCTCTTGC
TCTGGAAGCAGCTCCAACATCGGAGGTAATACTGTACACTGGTTCCAGCAGCTCCCAGGAACGGCC
CCCAAACTCCTCATCTATACTAATAGTCTGCGGCCCTCAGGGGTCCCTGACCGATTCTCTGGCTCC
AAGTCTGGCACCTCAGCCTCCCTGGCCATCAGTGGGCTCCAGTCTGAGGATGAGGCTGATTATTAC
TGTGCAGCATGGGATGACAGCCTAAATGGTCAGGTGTTCGGCGGAGGGACCAAGCTGACCGTCCTA

TABLE 1B

Antibody 3I14 Variable Region amino acid sequences $V_H$ chain of 3I14 (SEQ ID NO: 1666)
QVQLLESGGGVVQPGRSLRLSCAASGFTFSNYGMHWVRQAPGKGLEWVAIISFDGSKKYY
ANSVKGRSTISRDNSKNTLSLQMNSLGPEDTALYYCAKLPSPYYFDSRFVWVAASAFHFW
GQGILVTVSS $V_L$ chain of 3I14 (SEQ ID NO:1668)
NFMLTQPPSASGTPGQRVTISCSGSSSNIGGNTVHWFQQLPGTAPKLLIYTNSLRPSGVPD
RFSGSKSGTSASLAISGLQSEDEADYYCAAWDDSLNGQVFGGGTKLTVL

TABLE 1C

| Antibody 3I14$V_L$D94N Variable Region nucleic acid sequence |
|---|
| $V_L$ chain of 3114$V_L$D94N (SEQ ID NO: 1669)<br>AATTTTATGCTGACTCAGCCACCCTCAGCGTCTGGGACCCCCGGGCAGAGGGTCACCATCTCTTGC<br>TCTGGAAGCAGCTCCAACATCGGAGGTAATACTGTACACTGGTTCCAGCAGCTCCCAGGAACGGCC<br>CCCAAACTCCTCATCTATACTAATAGTCTGCGGCCCTCAGGGGTCCCTGACCGATTCTCTGGCTCC<br>AAGTCTGGCACCTCAGCCTCCCTGGCCATCAGTGGGCTCCAGTCTGAGGATGAGGCTGATTATTAC<br>TGTGCAGCATGGGATAACAGCCTAAATGGTCAGGTGTTCGGCGGAGGGACCAAGCTGACCGTCCTA |
| $V_L$ chain of 3I14$V_L$D94N (SEQ ID NO: 1670)<br>NFMLTQPPSASGTPGQRVTISCSGSSSNIGGNTVHWFQQLPGTAPKLLIYTNSLRPSGVPD<br>RFSGSKSGTSASLAISGLQSEDEADYYCAAWDNSLNGQVFGGGTKLTVL |

The amino acid sequences of the heavy and light chain complementary determining regions of the 3I14 and 3I14$V_L$D94N neutralizing influenza antibodies are shown in the below Table 2

TABLE 2

| | | |
|---|---|---|
| HCDR1 | GFTFSNYG | (SEQ ID NO: 1671) |
| HCDR2 | ISFDGSKK | (SEQ ID NO: 1672) |
| HCDR3 | CAKLPSPYYFDSRFVWVA ASAFHFW | (SEQ ID NO: 1673) |
| LCDR1 | SSNIGGNT | (SEQ ID NO: 1674) |
| LCDR2 | TNS | (SEQ ID NO: 1675) |
| LCDR3 | CAAWDDSLNGQVF | (SEQ ID NO: 1676) |
| 3I14$V_L$D94N LCDR3 | CAAWDNSLNGQVF | (SEQ ID NO: 1677) |

Other binding domain than scFv can also be used for predefined targeting of lymphocytes, such as camelid single-domain antibody fragments or receptor ligands, antibody binding domains, antibody hypervariable loops or CDRs as non limiting examples.

In a preferred embodiment said transmembrane domain further comprises a stalk region between said extracellular ligand-binding domain and said transmembrane domain. The term "stalk region" used herein generally means any oligo- or polypeptide that functions to link the transmembrane domain to the extracellular ligand-binding domain. In particular, stalk region are used to provide more flexibility and accessibility for the extracellular ligand-binding domain. A stalk region may comprise up to 300 amino acids, preferably 10 to 100 amino acids and most preferably 25 to 50 amino acids. Stalk region may be derived from all or part of naturally occurring molecules, such as from all or part of the extracellular region of CD8, CD4 or CD28, or from all or part of an antibody constant region. Alternatively the stalk region may be a synthetic sequence that corresponds to a naturally occurring stalk sequence, or may be an entirely synthetic stalk sequence. In a preferred embodiment said stalk region is a part of human CD8 alpha chain The signal transducing domain or intracellular signaling domain of the CAR of the invention is responsible for intracellular signaling following the binding of extracellular ligand binding domain to the target resulting in the activation of the immune cell and immune response. In other words, the signal transducing domain is responsible for the activation of at least one of the normal effector functions of the immune cell in which the CAR is expressed. For example, the effector function of a T cell can be a cytolytic activity or helper activity including the secretion of cytokines. Thus, the term "signal transducing domain" refers to the portion of a protein which transduces the effector signal function signal and directs the cell to perform a specialized function.

Signal transduction domain comprises two distinct classes of cytoplasmic signaling sequence, those that initiate antigen-dependent primary activation, and those that act in an antigen-independent manner to provide a secondary or co-stimulatory signal. Primary cytoplasmic signaling sequence can comprise signaling motifs which are known as immunoreceptor tyrosine-based activation motifs of ITAMs. ITAMs are well defined signaling motifs found in the intracytoplasmic tail of a variety of receptors that serve as binding sites for syk/zap70 class tyrosine kinases. Examples of ITAM used in the invention can include as non limiting examples those derived from TCR zeta, FcR gamma, FcR beta, FcR epsilon, CD3 gamma, CD3 delta, CD3 epsilon, CD5, CD22, CD79a, CD79b and CD66d. In a preferred embodiment, the signaling transducing domain of the CAR can comprise the CD3 zeta signaling domain, or the intracytoplasmic domain of the Fc epsilon RI beta or gamma chains. In another preferred embodiment, the signaling is provided by CD3 zeta together with co-stimulation provided by CD28 and a tumor necrosis factor receptor (TNFr), such as 4-1BB or OX40), for example.

In particular embodiment the intracellular signaling domain of the CAR of the present invention comprises a co-stimulatory signal molecule. In some embodiments the intracellular signaling domain contains 2, 3, 4 or more co-stimulatory molecules in tandem. A co-stimulatory molecule is a cell surface molecule other than an antigen receptor or their ligands that is required for an efficient immune response.

"Co-stimulatory ligand" refers to a molecule on an antigen presenting cell that specifically binds a cognate co-stimulatory molecule on a T-cell, thereby providing a signal which, in addition to the primary signal provided by, for instance, binding of a TCR/CD3 complex with an MHC molecule loaded with peptide, mediates a T cell response, including, but not limited to, proliferation activation, differentiation and the like. A co-stimulatory ligand can include but is not limited to, CD7, B7-1 (CD80), B7-2 (CD86), PD-L1, PD-L2, 4-1BBL, OX40L, inducible costimulatory ligand (ICOS-L), intercellular adhesion molecule (ICAM, CD30L, CD40, CD70, CD83, HLA-G, MICA, M1CB, HVEM, lymphotoxin beta receptor, 3/TR6, ILT3, ILT4, an agonist or antibody that binds Toll ligand receptor and a ligand that specifically binds with B7-H3. A co-stimulatory ligand also encompasses, inter alia, an antibody that specifically binds with a co-stimulatory molecule present on a T cell, such as but not limited to, CD27, CD28, 4-IBB, OX40, CD30, CD40, PD-1, ICOS, lymphocyte function-associated antigen-1 (LFA-1), CD2, CD7, LTGHT, NKG2C, B7-H3, a ligand that specifically binds with CD83.

A "co-stimulatory molecule" refers to the cognate binding partner on a T-cell that specifically binds with a co-stimulatory ligand, thereby mediating a co-stimulatory response by the cell, such as, but not limited to proliferation. Co-stimulatory molecules include, but are not limited to an MHC class 1 molecule, BTLA and Toll ligand receptor. Examples of costimulatory molecules include CD27, CD28, CD8, 4-1BB (CD137), OX40, CD30, CD40, PD-1, ICOS, lymphocyte function-associated antigen-1 (LFA-1), CD2, CD7, LIGHT, NKG2C, B7-H3 and a ligand that specifically binds with CD83 and the like. The In another particular embodiment, said signal transducing domain is a TNFR-associated Factor 2 (TRAF2) binding motifs, intracytoplasmic tail of costimulatory TNFR member family. Cytoplasmic tail of costimulatory TNFR family member contains TRAF2 binding motifs consisting of the major conserved motif (P/S/A)X(Q/E)E) or the minor motif (PXQXXD), wherein X is any amino acid. TRAF proteins are recruited to the intracellular tails of many TNFRs in response to receptor trimerization.

The distinguishing features of appropriate transmembrane polypeptides comprise the ability to be expressed at the surface of an immune cell, in particular lymphocyte cells or Natural killer (NK) cells, and to interact together for directing cellular response of immune cell against a predefined target cell. The different transmembrane polypeptides of the CAR of the present invention comprising an extracellular ligand-biding domain and/or a signal transducing domain interact together to take part in signal transduction following the binding with a target ligand and induce an immune response. The transmembrane domain can be derived either from a natural or from a synthetic source. The transmembrane domain can be derived from any membrane-bound or transmembrane protein.

The term "a part of" used herein refers to any subset of the molecule, that is a shorter peptide. Alternatively, amino acid sequence functional variants of the polypeptide can be prepared by mutations in the DNA which encodes the polypeptide. Such variants or functional variants include, for example, deletions from, or insertions or substitutions of, residues within the amino acid sequence. Any combination of deletion, insertion, and substitution may also be made to arrive at the final construct, provided that the final construct possesses the desired activity, especially to exhibit a specific anti-target cellular immune activity. The functionality of the CAR of the invention within a host cell is detectable in an assay suitable for demonstrating the signaling potential of said CAR upon binding of a particular target. Such assays are available to the skilled person in the art. For example, this assay allows the detection of a signaling pathway, triggered upon binding of the target, such as an assay involving measurement of the increase of calcium ion release, intracellular tyrosine phosphorylation, inositol phosphate turnover, or interleukin (IL) 2, interferon .gamma., GM-CSF, IL-3, IL-4 production thus effected.

Cells

Embodiments of the invention include cells that express a CAR (i.e, CARTS). The cell may be of any kind, including an immune cell capable of expressing the CAR for cancer therapy or a cell, such as a bacterial cell, that harbors an expression vector that encodes the CAR. As used herein, the terms "cell," "cell line," and "cell culture" may be used interchangeably. All of these terms also include their progeny, which is any and all subsequent generations. It is understood that all progeny may not be identical due to deliberate or inadvertent mutations. In the context of expressing a heterologous nucleic acid sequence, "host cell" refers to a eukaryotic cell that is capable of replicating a vector and/or expressing a heterologous gene encoded by a vector. A host cell can, and has been, used as a recipient for vectors. A host cell may be "transfected" or "transformed," which refers to a process by which exogenous nucleic acid is transferred or introduced into the host cell. A transformed cell includes the primary subject cell and its progeny. As used herein, the terms "engineered" and "recombinant" cells or host cells are intended to refer to a cell into which an exogenous nucleic acid sequence, such as, for example, a vector, has been introduced. Therefore, recombinant cells are distinguishable from naturally occurring cells which do not contain a recombinantly introduced nucleic acid. In embodiments of the invention, a host cell is a T cell, including a cytotoxic T cell (also known as TC, Cytotoxic T Lymphocyte, CTL, T-Killer cell, cytolytic T cell, $CD8^+$ T-cells or killer T cell); NK cells and NKT cells are also encompassed in the invention.

Some vectors may employ control sequences that allow it to be replicated and/or expressed in both prokaryotic and eukaryotic cells. One of skill in the art would further understand the conditions under which to incubate all of the above described host cells to maintain them and to permit replication of a vector. Also understood and known are techniques and conditions that would allow large-scale production of vectors, as well as production of the nucleic acids encoded by vectors and their cognate polypeptides, proteins, or peptides.

The cells can be autologous cells, syngeneic cells, allogenic cells and even in some cases, xenogeneic cells.

In many situations one may wish to be able to kill the modified CTLs, where one wishes to terminate the treatment, the cells become neoplastic, in research where the absence of the cells after their presence is of interest, or other event. For this purpose one can provide for the expression of certain gene products in which one can kill the modified cells under controlled conditions, such as inducible suicide genes.

Armed CARTS

The invention further includes CARTS that are modified to secrete one or more polypeptides. The polypeptide can be for example an antibody or cytokine. Preferably, the antibody is specific for CAIX, GITR, PD-L1, PD-L2. PD-1, or CCR4

Armed CARTS have the advantage of simultaneously secreting a polypeptide at the targeted site, e.g. tumor site.

Armed CART can be constructed by including a nucleic acid encoding the polypeptide of interest after the intracellular signaling domain. Preferably, there is an internal ribosome entry site, (IRES), positioned between the intracellular signaling domain and the polypeptide of interest. One skilled in the art can appreciate that more than one polypeptide can be expressed by employing multiple IRES sequences in tandem.

In one embodiment, the methods and compositions presented herein provide a target-specific Anti-CAIX CAR T cell of second generation armed with the power to secrete anti-PD-L1 IgGs in the RCC milieu to combat T cell exhaustion. The human Anti-CAIX CAR containing the CD28 co-stimulatory domain was chosen based in its killing activity and low immunogenicity in human cRCC xenografts in mice. The Anti-CAIX CART cells-secreting Anti-PD-L1 IgG1 or IgG4 was extensively compared with an unrelated Anti-BCMA CAR or with an Anti-CAIX CAR, both secreting an irrelevant Anti-SARS IgG1. We have demonstrated stable expression of the CARs and high proliferation of all CART cells. Anti-CAIX CART cells have capacity to undergo clonal expansion when in contact with CAIX+ RCC cells, and were also activated, releasing high levels of IFN☐ and IL-2, which could improve tumor suppression. These Anti-CAIX CART cells are also able to secrete high levels of Anti-PD-L1 IgG1 or IgG4 and these antibodies can interact specifically with PD-L1, inducing downregulation of the exhaustion markers PD-1, Tim-3 and Lag-3 in vitro and in vivo. These results have shown that the Anti-PD-L1 antibodies secreted in the tumor microenvironment are able to revert T cell exhaustion, facilitating the Anti-CAIX CART cells antitumor activity. These Anti-CAIX CART cells, mainly the ones secreting anti-PD-L1, are also able to diminish the proliferation of CAIX+ RCC cells, resulting in a slow tumor growth and small tumor size and weight in an orthotopic NSG mice model of RCC. In addition, Anti-CAIX CART cell secreting the IgG1 isotype of Anti-PD-L1 was also able to induce ADCC in vitro and increased the number of human NK cells infiltrating the tumor site in vivo. The human NK cells were injected only in 2 mice of each group, two days before their euthanasia to determine the NK cells capacity to recognize the IgG1 isotype of the Anti-PD-L1 in vivo, which was attested. The injection of human NK cells was not made in the beginning of the treatment once our previous experience with this mice model showed that these cells last only for a few days in their blood In one embodiment, the injection of CART cells into mice was performed without the addition of interleukins to avoid their influence in the therapeutic effect of CART cells alone.

In another embodiment, CART cells can be maintained with the use of cytokines such as, for example, IL-2, IL-4, IL-7, IL-9, IL-15 and IL-21.

Cytokines sharing the γc receptor, like IL-2, IL-4, IL-7, IL-9, IL-15 and IL-21 are important for the development and maintenance of memory T cells. Among them, IL-21 promote a less differentiated phenotype, associated with an enrichment of tumor-specific CD8 T cells, with increased anti-tumor effect in a mouse melanoma model when compared to IL-2 or IL-15.

In certain embodiments, CART cells are maintained with IL-21.

CAIX is a consistent marker for development of cancer targeted systemic therapies due to it overexpression in many tumors, remarkably in cRCC, but it is also expressed physiologically in a few tissues.

In one embodiment, the anti-CAIX scFv in the CAR recognizes the catalytic domain of CAIX, located in the central portion of the protein, which could increase its specificity to sites of higher expression of CAIX.

The choice of CD28 as a co-stimulatory domain for the CARs presented herein was based in the fact that CD28 CARs direct an active proliferative response and enhance effector functions, whereas 4-1BB-based CARs induce a more progressive T cell accumulation that may counterweigh for less immediate effectiveness. In one embodiment, the CD28 is replaced by 41BB in the CAR constructs.

T cell exhaustion is common in cancer and these T cells present low capacities of proliferation and cytokine production associated with high apoptosis rate and expression of inhibitory receptors like PD-1, Tim-3 and Lag3. New strategies for preventing T cell exhaustion include of PD-1/PD-L1 axis.

The methods and compositions presented herein provide Anti-CAIX CART cells-secreting Anti-PD-L1 IgG1 or IgG4 that can diminish T cell exhaustion, improving CART cell efficiency in the cRCC treatment in vitro and in vivo.

Introduction of Constructs Into CTLs

Expression vectors that encode the CARs can be introduced as one or more DNA molecules or constructs, where there may be at least one marker that will allow for selection of host cells that contain the construct(s).

The constructs can be prepared in conventional ways, where the genes and regulatory regions may be isolated, as appropriate, ligated, cloned in an appropriate cloning host, analyzed by restriction or sequencing, or other convenient means. Particularly, using PCR, individual fragments including all or portions of a functional unit may be isolated, where one or more mutations may be introduced using "primer repair", ligation, in vitro mutagenesis, etc., as appropriate. The construct(s) once completed and demonstrated to have the appropriate sequences may then be introduced into the CTL by any convenient means. The constructs may be integrated and packaged into non-replicating, defective viral genomes like Adenovirus, Adeno-associated virus (AAV), or Herpes simplex virus (HSV) or others, including retroviral vectors or lentiviral vectors, for infection or transduction into cells. The constructs may include viral sequences for transfection, if desired. Alternatively, the construct may be introduced by fusion, electroporation, biolistics, transfection, lipofection, or the like. The host cells may be grown and expanded in culture before introduction of the construct(s), followed by the appropriate treatment for introduction of the construct(s) and integration of the construct(s). The cells are then expanded and screened by virtue of a marker present in the construct. Various markers that may be used successfully include hprt, neomycin resistance, thymidine kinase, hygromycin resistance, etc.

In some instances, one may have a target site for homologous recombination, where it is desired that a construct be integrated at a particular locus. For example) can knock-out an endogenous gene and replace it (at the same locus or elsewhere) with the gene encoded for by the construct using materials and methods as are known in the art for homologous recombination. For homologous recombination, one may use either .OMEGA. or O-vectors. See, for example, Thomas and Capecchi, Cell (1987) 51, 503-512; Mansour, et al., Nature (1988) 336, 348-352; and Joyner, et al., Nature (1989) 338, 153-156.

The constructs may be introduced as a single DNA molecule encoding at least the CAR and optionally another gene, or different DNA molecules having one or more genes. Other genes include genes that encode therapeutic molecules or suicide genes, for example. The constructs may be introduced simultaneously or consecutively, each with the same or different markers.

Vectors containing useful elements such as bacterial or yeast origins of replication, selectable and/or amplifiable markers, promoter/enhancer elements for expression in prokaryotes or eukaryotes, etc. that may be used to prepare stocks of construct DNAs and for carrying out transfections are well known in the art, and many are commercially available.

Methods of Use

The cells according to the invention can be used for treating cancer, viral infections or autoimmune disorders in a patient in need thereof. In another embodiment, said isolated cell according to the invention can be used in the manufacture of a medicament for treatment of a cancer, viral infections of autoimmune disorders, in a patient in need thereof.

The present invention relies on methods for treating patients in need thereof, said method comprising at least one of the following steps: (a) providing a chimeric antigen receptor cells according to the invention and (b) administrating the cells to said patient.

Said treatment can be ameliorating, curative or prophylactic. It may be either part of an autologous immunotherapy or part of an allogenic immunotherapy treatment. By autologous, it is meant that cells, cell line or population of cells used for treating patients are originating from said patient or from a Human Leucocyte Antigen (HLA) compatible donor. By allogeneic is meant that the cells or population of cells used for treating patients are not originating from said patient but from a donor.

The invention is particularly suited for allogenic immunotherapy, insofar as it enables the transformation of T-cells, typically obtained from donors, into non-alloreactive cells. This may be done under standard protocols and reproduced as many times as needed. The resulted modified T cells may be pooled and administrated to one or several patients, being made available as an "off the shelf" therapeutic product.

Cells that can be used with the disclosed methods are described in the previous section. Said treatment can be used to treat patients diagnosed with cancer, viral infection, autoimmune disorders or Graft versus Host Disease (GvHD). Cancers that may be treated include tumors that are not vascularized, or not yet substantially vascularized, as well as vascularized tumors. The cancers may comprise nonsolid tumors (such as hematological tumors, for example, leukemias and lymphomas) or may comprise solid tumors. Types of cancers to be treated with the CARs of the invention include, but are not limited to, carcinoma, blastoma, and sarcoma, and certain leukemia or lymphoid malignancies, benign and malignant tumors, and malignancies e.g., sarcomas, carcinomas, and melanomas. Adult tumors/cancers and pediatric tumors/cancers are also included.

It can be a treatment in combination with one or more therapies against cancer selected from the group of antibodies therapy, chemotherapy, cytokines therapy, dendritic cell therapy, gene therapy, hormone therapy, laser light therapy and radiation therapy.

According to a preferred embodiment of the invention, said treatment can be administrated into patients undergoing an immunosuppressive treatment. Indeed, the present invention preferably relies on cells or population of cells, which have been made resistant to at least one immunosuppressive agent due to the inactivation of a gene encoding a receptor for such immunosuppressive agent. In this aspect, the immunosuppressive treatment should help the selection and expansion of the T-cells according to the invention within the patient.

In a further embodiment, the cell compositions of the present invention are administered to a patient in conjunction with (e.g., before, simultaneously or following) bone marrow transplantation, T cell ablative therapy using either chemotherapy agents such as, fludarabine, external-beam radiation therapy (XRT), cyclophosphamide, or antibodies such as OKT3 or CAM PATH. In another embodiment, the cell compositions of the present invention are administered following B-cell ablative therapy such as agents that react with CD20, e.g., Rituxan. For example, in one embodiment, subjects may undergo standard treatment with high dose chemotherapy followed by peripheral blood stem cell transplantation. In certain embodiments, following the transplant, subjects receive an infusion of the expanded immune cells of the present invention. In an additional embodiment, expanded cells are administered before or following surgery.

Said modified cells obtained by any one of the methods described here can be used in a particular aspect of the invention for treating patients in need thereof against Host versus Graft (HvG) rejection and Graft versus Host Disease (GvHD); therefore in the scope of the present invention is a method of treating patients in need thereof against Host versus Graft (HvG) rejection and Graft versus Host Disease (GvHD) comprising treating said patient by administering to said patient an effective amount of modified cells comprising inactivated TCR alpha and/or TCR beta genes.

Administration of Cells

The invention is particularly suited for allogenic immunotherapy, insofar as it enables the transformation of T-cells, typically obtained from donors, into non-alloreactive cells. This may be done under standard protocols and reproduced as many times as needed. The resulted modified T cells may be pooled and administrated to one or several patients, being made available as an "off the shelf" therapeutic product.

Depending upon the nature of the cells, the cells may be introduced into a host organism, e.g. a mammal, in a wide variety of ways. The cells may be introduced at the site of the tumor, in specific embodiments, although in alternative embodiments the cells hone to the cancer or are modified to hone to the cancer. The number of cells that are employed will depend upon a number of circumstances, the purpose for the introduction, the lifetime of the cells, the protocol to be used, for example, the number of administrations, the ability of the cells to multiply, the stability of the recombinant construct, and the like. The cells may be applied as a dispersion, generally being injected at or near the site of interest. The cells may be in a physiologically-acceptable medium.

In some embodiments, the cells are encapsulated to inhibit immune recognition and placed at the site of the tumor.

The cells may be administered as desired. Depending upon the response desired, the manner of administration, the life of the cells, the number of cells present, various protocols may be employed. The number of administrations will depend upon the factors described above at least in part.

The administration of the cells or population of cells according to the present invention may be carried out in any convenient manner, including by aerosol inhalation, injection, ingestion, transfusion, implantation or transplantation. The compositions described herein may be administered to a patient subcutaneously, intradermaly, intratumorally, intranodally, intramedullary, intramuscularly, by intravenous or intralymphatic injection, or intraperitoneally. In one embodiment, the cell compositions of the present invention are preferably administered by intravenous injection.

The administration of the cells or population of cells can consist of the administration of $10^4$-$10^9$ cells per kg body weight, preferably $10^5$ to $10^6$ cells/kg body weight including all integer values of cell numbers within those ranges. The cells or population of cells can be administrated in one or more doses. In another embodiment, said effective amount of cells are administrated as a single dose. In another embodiment, said effective amount of cells are administrated as more than one dose over a period time. Timing of administration is within the judgment of managing physician and depends on the clinical condition of the patient. The cells or population of cells may be obtained from any source, such as a blood bank or a donor. While individual needs vary, determination of optimal ranges of effective amounts of a given cell type for a particular disease or conditions within the skill of the art. An effective amount means an amount which provides a therapeutic or prophylactic benefit.

The dosage administered will be dependent upon the age, health and weight of the recipient, kind of concurrent treatment, if any, frequency of treatment and the nature of the effect desired.

It should be appreciated that the system is subject to many variables, such as the cellular response to the ligand, the efficiency of expression and, as appropriate, the level of secretion, the activity of the expression product, the particular need of the patient, which may vary with time and circumstances, the rate of loss of the cellular activity as a result of loss of cells or expression activity of individual cells, and the like. Therefore, it is expected that for each individual patient, even if there were universal cells which could be administered to the population at large, each patient would be monitored for the proper dosage for the individual, and such practices of monitoring a patient are routine in the art.

Nucleic Acid-Based Expression Systems

The CARs of the present invention may be expressed from an expression vector. Recombinant techniques to generate such expression vectors are well known in the art.

Vectors

The term "vector" is used to refer to a carrier nucleic acid molecule into which a nucleic acid sequence can be inserted for introduction into a cell where it can be replicated. A nucleic acid sequence can be "exogenous," which means that it is foreign to the cell into which the vector is being introduced or that the sequence is homologous to a sequence in the cell but in a position within the host cell nucleic acid in which the sequence is ordinarily not found. Vectors include plasmids, cosmids, viruses (bacteriophage, animal viruses, and plant viruses), and artificial chromosomes (e.g., YACs). One of skill in the art would be well equipped to construct a vector through standard recombinant techniques (see, for example, Maniatis et al., 1988 and Ausubel et al., 1994, both incorporated herein by reference).

The term "expression vector" refers to any type of genetic construct comprising a nucleic acid coding for a RNA capable of being transcribed. In some cases, RNA molecules are then translated into a protein, polypeptide, or peptide. In other cases, these sequences are not translated, for example, in the production of antisense molecules or ribozymes. Expression vectors can contain a variety of "control sequences," which refer to nucleic acid sequences necessary for the transcription and possibly translation of an operably linked coding sequence in a particular host cell. In addition to control sequences that govern transcription and translation, vectors and expression vectors may contain nucleic acid sequences that serve other functions as well and are described infra.

Promoters and Enhancers

A "promoter" is a control sequence that is a region of a nucleic acid sequence at which initiation and rate of transcription are controlled. It may contain genetic elements at which regulatory proteins and molecules may bind, such as RNA polymerase and other transcription factors, to initiate the specific transcription a nucleic acid sequence. The phrases "operatively positioned," "operatively linked," "under control," and "under transcriptional control" mean that a promoter is in a correct functional location and/or orientation in relation to a nucleic acid sequence to control transcriptional initiation and/or expression of that sequence.

A promoter generally comprises a sequence that functions to position the start site for RNA synthesis. The best known example of this is the TATA box, but in some promoters lacking a TATA box, such as, for example, the promoter for the mammalian terminal deoxynucleotidyl transferase gene and the promoter for the SV40 late genes, a discrete element overlying the start site itself helps to fix the place of initiation. Additional promoter elements regulate the frequency of transcriptional initiation. Typically, these are located in the region 30 110 bp upstream of the start site, although a number of promoters have been shown to contain functional elements downstream of the start site as well. To bring a coding sequence "under the control of" a promoter, one positions the 5' end of the transcription initiation site of the transcriptional reading frame "downstream" of (i.e., 3' of) the chosen promoter. The "upstream" promoter stimulates transcription of the DNA and promotes expression of the encoded RNA.

The spacing between promoter elements frequently is flexible, so that promoter function is preserved when elements are inverted or moved relative to one another. In the tk promoter, the spacing between promoter elements can be increased to 50 bp apart before activity begins to decline. Depending on the promoter, it appears that individual elements can function either cooperatively or independently to activate transcription. A promoter may or may not be used in conjunction with an "enhancer," which refers to a cis-acting regulatory sequence involved in the transcriptional activation of a nucleic acid sequence.

A promoter may be one naturally associated with a nucleic acid sequence, as may be obtained by isolating the 5 prime' non-coding sequences located upstream of the coding segment and/or exon. Such a promoter can be referred to as "endogenous." Similarly, an enhancer may be one naturally associated with a nucleic acid sequence, located either downstream or upstream of that sequence. Alternatively, certain advantages will be gained by positioning the coding nucleic acid segment under the control of a recombinant or heterologous promoter, which refers to a promoter that is not normally associated with a nucleic acid sequence in its natural environment. A recombinant or heterologous enhancer refers also to an enhancer not normally associated with a nucleic acid sequence in its natural environment. Such promoters or enhancers may include promoters or enhancers of other genes, and promoters or enhancers isolated from any other virus, or prokaryotic or eukaryotic cell, and promoters or enhancers not "naturally occurring," i.e., containing different elements of different transcriptional regulatory regions, and/or mutations that alter expression. For example, promoters that are most commonly used in recombinant DNA construction include the lactamase (penicillinase), lactose and tryptophan (trp) promoter systems. In addition to producing nucleic acid sequences of promoters and enhancers synthetically, sequences may be produced using recombinant cloning and/or nucleic acid amplification technology, including PCR™, in connection with the compositions disclosed herein (see U.S. Pat. Nos. 4,683,202 and 5,928,906, each incorporated herein by reference). Furthermore, it is contemplated the control sequences that direct transcription and/or expression of sequences within non-nuclear organelles such as mitochondria, chloroplasts, and the like, can be employed as well.

Naturally, it will be important to employ a promoter and/or enhancer that effectively directs the expression of the DNA segment in the organelle, cell type, tissue, organ, or organism chosen for expression. Those of skill in the art of molecular biology generally know the use of promoters, enhancers, and cell type combinations for protein expression, (see, for example Sambrook et al. 1989, incorporated herein by reference). The promoters employed may be constitutive, tissue-specific, inducible, and/or useful under the appropriate conditions to direct high level expression of the introduced DNA segment, such as is advantageous in the large-scale production of recombinant proteins and/or peptides. The promoter may be heterologous or endogenous.

Additionally any promoter/enhancer combination could also be used to drive expression. Use of a T3, T7 or SP6 cytoplasmic expression system is another possible embodiment. Eukaryotic cells can support cytoplasmic transcription from certain bacterial promoters if the appropriate bacterial polymerase is provided, either as part of the delivery complex or as an additional genetic expression construct.

The identity of tissue-specific promoters or elements, as well as assays to characterize their activity, is well known to those of skill in the art.

A specific initiation signal also may be required for efficient translation of coding sequences. These signals include the ATG initiation codon or adjacent sequences. Exogenous translational control signals, including the ATG initiation codon, may need to be provided. One of ordinary skill in the art would readily be capable of determining this and providing the necessary signals In certain embodiments of the invention, the use of internal ribosome entry sites (IRES) elements are used to create multigene, or polycistronic, messages, and these may be used in the invention.

Vectors can include a multiple cloning site (MCS), which is a nucleic acid region that contains multiple restriction enzyme sites, any of which can be used in conjunction with standard recombinant technology to digest the vector. "Restriction enzyme digestion" refers to catalytic cleavage of a nucleic acid molecule with an enzyme that functions only at specific locations in a nucleic acid molecule. Many of these restriction enzymes are commercially available. Use of such enzymes is widely understood by those of skill in the art. Frequently, a vector is linearized or fragmented using a restriction enzyme that cuts within the MCS to enable exogenous sequences to be ligated to the vector. "Ligation" refers to the process of forming phosphodiester bonds between two nucleic acid fragments, which may or may not be contiguous with each other. Techniques involving restriction enzymes and ligation reactions are well known to those of skill in the art of recombinant technology.

Splicing sites, termination signals, origins of replication, and selectable markers may also be employed.

Plasmid Vectors

In certain embodiments, a plasmid vector is contemplated for use to transform a host cell. In general, plasmid vectors containing replicon and control sequences which are derived from species compatible with the host cell are used in connection with these hosts. The vector ordinarily carries a replication site, as well as marking sequences which are capable of providing phenotypic selection in transformed cells. In a non-limiting example, E. coli is often transformed using derivatives of pBR322, a plasmid derived from an E. coli species. pBR322 contains genes for ampicillin and tetracycline resistance and thus provides easy means for identifying transformed cells. The pBR plasmid, or other microbial plasmid or phage must also contain, or be modified to contain, for example, promoters which can be used by the microbial organism for expression of its own proteins.

In addition, phage vectors containing replicon and control sequences that are compatible with the host microorganism can be used as transforming vectors in connection with these hosts. For example, the phage lambda GEM™ 11 may be utilized in making a recombinant phage vector which can be used to transform host cells, such as, for example, E. coli LE392.

Further useful plasmid vectors include pIN vectors (Inouye et al., 1985); and pGEX vectors, for use in generating glutathione S transferase (GST) soluble fusion proteins for later purification and separation or cleavage. Other suitable fusion proteins are those with galactosidase, ubiquitin, and the like.

Bacterial host cells, for example, E. coli, comprising the expression vector, are grown in any of a number of suitable media, for example, LB. The expression of the recombinant protein in certain vectors may be induced, as would be understood by those of skill in the art, by contacting a host cell with an agent specific for certain promoters, e.g., by adding IPTG to the media or by switching incubation to a higher temperature. After culturing the bacteria for a further period, generally of between 2 and 24 h, the cells are collected by centrifugation and washed to remove residual media.

Viral Vectors

The ability of certain viruses to infect cells or enter cells via receptor mediated endocytosis, and to integrate into host cell genome and express viral genes stably and efficiently have made them attractive candidates for the transfer of foreign nucleic acids into cells (e.g., mammalian cells). Components of the present invention may be a viral vector that encodes one or more CARs of the invention. Non-limiting examples of virus vectors that may be used to deliver a nucleic acid of the present invention are described below.

Adenoviral Vectors

A particular method for delivery of the nucleic acid involves the use of an adenovirus expression vector. Although adenovirus vectors are known to have a low capacity for integration into genomic DNA, this feature is counterbalanced by the high efficiency of gene transfer afforded by these vectors. "Adenovirus expression vector" is meant to include those constructs containing adenovirus sequences sufficient to (a) support packaging of the construct and (b) to ultimately express a tissue or cell specific construct that has been cloned therein. Knowledge of the genetic organization or adenovirus, a 36 kb, linear, double stranded DNA virus, allows substitution of large pieces of adenoviral DNA with foreign sequences up to 7 kb (Grunhaus and Horwitz, 1992).

AAV Vectors

The nucleic acid may be introduced into the cell using adenovirus assisted transfection. Increased transfection efficiencies have been reported in cell systems using adenovirus coupled systems (Kelleher and Vos, 1994; Cotten et al., 1992; Curiel, 1994). Adeno associated virus (AAV) is an attractive vector system for use in the cells of the present invention as it has a high frequency of integration and it can infect nondividing cells, thus making it useful for delivery of genes into mammalian cells, for example, in tissue culture (Muzyczka, 1992) or in vivo. AAV has a broad host range for infectivity (Tratschin et al., 1984; Laughlin et al., 1986; Lebkowski et al., 1988; McLaughlin et al., 1988). Details concerning the generation and use of rAAV vectors are described in U.S. Pat. Nos. 5,139,941 and 4,797,368, each incorporated herein by reference.

Retroviral Vectors

Retroviruses are useful as delivery vectors because of their ability to integrate their genes into the host genome, transferring a large amount of foreign genetic material, infecting a broad spectrum of species and cell types and of being packaged in special cell lines (Miller, 1992).

In order to construct a retroviral vector, a nucleic acid (e.g., one encoding the desired sequence) is inserted into the viral genome in the place of certain viral sequences to produce a virus that is replication defective. In order to produce virions, a packaging cell line containing the gag, pol, and env genes but without the LTR and packaging components is constructed (Mann et al., 1983). When a recombinant plasmid containing a cDNA, together with the retroviral LTR and packaging sequences is introduced into a special cell line (e.g., by calcium phosphate precipitation for example), the packaging sequence allows the RNA transcript of the recombinant plasmid to be packaged into viral particles, which are then secreted into the culture media (Nicolas and Rubenstein, 1988; Temin, 1986; Mann et al., 1983). The media containing the recombinant retroviruses is then collected, optionally concentrated, and used for gene transfer. Retroviral vectors are able to infect a broad variety of cell types. However, integration and stable expression require the division of host cells (Paskind et al., 1975).

Lentiviruses are complex retroviruses, which, in addition to the common retroviral genes gag, pol, and env, contain other genes with regulatory or structural function. Lentiviral vectors are well known in the art (see, for example, Naldini et al., 1996; Zufferey et al., 1997; Blomer et al., 1997; U.S. Pat. Nos. 6,013,516 and 5,994,136). Some examples of lentivirus include the Human Immunodeficiency Viruses: HIV-1, HIV-2 and the Simian Immunodeficiency Virus: SIV. Lentiviral vectors have been generated by multiply attenuating the HIV virulence genes, for example, the genes env, vif, vpr, vpu and nef are deleted making the vector biologically safe.

Recombinant lentiviral vectors are capable of infecting non-dividing cells and can be used for both in vivo and ex vivo gene transfer and expression of nucleic acid sequences. For example, recombinant lentivirus capable of infecting a non-dividing cell wherein a suitable host cell is transfected with two or more vectors carrying the packaging functions, namely gag, pol and env, as well as rev and tat is described in U.S. Pat. No. 5,994,136, incorporated herein by reference. One may target the recombinant virus by linkage of the envelope protein with an antibody or a particular ligand for targeting to a receptor of a particular cell-type. By inserting a sequence (including a regulatory region) of interest into the viral vector, along with another gene which encodes the ligand for a receptor on a specific target cell, for example, the vector is now target-specific.

Other Viral Vectors

Other viral vectors may be employed as vaccine constructs in the present invention. Vectors derived from viruses such as vaccinia virus (Ridgeway, 1988; Baichwal and Sugden, 1986; Coupar et al., 1988), sindbis virus, cytomegalovirus and herpes simplex virus may be employed. They offer several attractive features for various mammalian cells (Friedmann, 1989; Ridgeway, 1988; Baichwal and Sugden, 1986; Coupar et al., 1988; Horwich et al., 1990).

Delivery Using Modified Viruses

A nucleic acid to be delivered may be housed within an infective virus that has been engineered to express a specific binding ligand. The virus particle will thus bind specifically to the cognate receptors of the target cell and deliver the contents to the cell. A novel approach designed to allow specific targeting of retrovirus vectors was developed based on the chemical modification of a retrovirus by the chemical addition of lactose residues to the viral envelope. This modification can permit the specific infection of hepatocytes via sialoglycoprotein receptors.

Another approach to targeting of recombinant retroviruses was designed in which biotinylated antibodies against a retroviral envelope protein and against a specific cell receptor were used. The antibodies were coupled via the biotin components by using streptavidin (Roux et al., 1989). Using antibodies against major histocompatibility complex class I and class II antigens, they demonstrated the infection of a variety of human cells that bore those surface antigens with an ecotropic virus in vitro (Roux et al., 1989).

Vector Delivery and Cell Transformation

Suitable methods for nucleic acid delivery for transfection or transformation of cells are known to one of ordinary skill in the art. Such methods include, but are not limited to, direct delivery of DNA such as by ex vivo transfection, by injection, and so forth. Through the application of techniques known in the art, cells may be stably or transiently transformed.

Ex Vivo Transformation

Methods for transfecting eukaryotic cells and tissues removed from an organism in an ex vivo setting are known to those of skill in the art. Thus, it is contemplated that cells or tissues may be removed and transfected ex vivo using nucleic acids of the present invention. In particular aspects, the transplanted cells or tissues may be placed into an organism. In preferred facets, a nucleic acid is expressed in the transplanted cells.

Kits of the Invention

Any of the compositions described herein may be comprised in a kit. In a non-limiting example, one or more cells for use in cell therapy and/or the reagents to generate one or more cells for use in cell therapy that harbors recombinant expression vectors may be comprised in a kit. The kit components are provided in suitable container means.

Some components of the kits may be packaged either in aqueous media or in lyophilized form. The container means of the kits will generally include at least one vial, test tube, flask, bottle, syringe or other container means, into which a component may be placed, and preferably, suitably aliquoted. Where there are more than one component in the kit, the kit also will generally contain a second, third or other additional container into which the additional components may be separately placed. However, various combinations of components may be comprised in a vial. The kits of the present invention also will typically include a means for containing the components in close confinement for commercial sale. Such containers may include injection or blow molded plastic containers into which the desired vials are retained.

When the components of the kit are provided in one and/or more liquid solutions, the liquid solution is an aqueous solution, with a sterile aqueous solution being particularly useful. In some cases, the container means may itself be a syringe, pipette, and/or other such like apparatus, from which the formulation may be applied to an infected area of the body, injected into an animal, and/or even applied to and/or mixed with the other components of the kit.

However, the components of the kit may be provided as dried powder(s). When reagents and/or components are provided as a dry powder, the powder can be reconstituted by the addition of a suitable solvent. It is envisioned that the solvent may also be provided in another container means. The kits may also comprise a second container means for containing a sterile, pharmaceutically acceptable buffer and/or other diluent.

In particular embodiments of the invention, cells that are to be used for cell therapy are provided in a kit, and in some cases the cells are essentially the sole component of the kit. The kit may comprise reagents and materials to make the desired cell. In specific embodiments, the reagents and materials include primers for amplifying desired sequences, nucleotides, suitable buffers or buffer reagents, salt, and so forth, and in some cases the reagents include vectors and/or DNA that encodes a CAR as described herein and/or regulatory elements therefor.

In particular embodiments, there are one or more apparatuses in the kit suitable for extracting one or more samples from an individual. The apparatus may be a syringe, scalpel, and so forth.

In some cases of the invention, the kit, in addition to cell therapy embodiments, also includes a second cancer therapy, such as chemotherapy, hormone therapy, and/or immunotherapy, for example. The kit(s) may be tailored to a particular cancer for an individual and comprise respective second cancer therapies for the individual.

Combination Therapy

In certain embodiments of the invention, methods of the present invention for clinical aspects are combined with other agents effective in the treatment of hyperproliferative disease, such as anti-cancer agents. An "anti-cancer" agent is capable of negatively affecting cancer in a subject, for example, by killing cancer cells, inducing apoptosis in cancer cells, reducing the growth rate of cancer cells, reducing the incidence or number of metastases, reducing tumor size, inhibiting tumor growth, reducing the blood supply to a tumor or cancer cells, promoting an immune response against cancer cells or a tumor, preventing or inhibiting the progression of cancer, or increasing the lifespan of a subject with cancer. More generally, these other compositions would be provided in a combined amount effective to kill or inhibit proliferation of the cell. This process may involve contacting the cancer cells with the expression construct and the agent(s) or multiple factor(s) at the same time. This may be achieved by contacting the cell with a single composition or pharmacological formulation that includes both agents, or by contacting the cell with two distinct compositions or formulations, at the same time, wherein one composition includes the expression construct and the other includes the second agent(s).

Tumor cell resistance to chemotherapy and radiotherapy agents represents a major problem in clinical oncology. One goal of current cancer research is to find ways to improve the efficacy of chemo- and radiotherapy by combining it with other therapies. In the context of the present invention, it is contemplated that cell therapy could be used similarly in conjunction with chemotherapeutic, radiotherapeutic, or immunotherapeutic intervention, as well as pro-apoptotic or cell cycle regulating agents.

Alternatively, the present inventive therapy may precede or follow the other agent treatment by intervals ranging from minutes to weeks. In embodiments where the other agent and present invention are applied separately to the individual, one would generally ensure that a significant period of time did not expire between the time of each delivery, such that the agent and inventive therapy would still be able to exert an advantageously combined effect on the cell. In such instances, it is contemplated that one may contact the cell with both modalities within about 12-24 h of each other and, more preferably, within about 6-12 h of each other. In some situations, it may be desirable to extend the time period for treatment significantly, however, where several d (2, 3, 4, 5, 6 or 7) to several wk (1, 2, 3, 4, 5, 6, 7 or 8) lapse between the respective administrations.

It is expected that the treatment cycles would be repeated as necessary. It also is contemplated that various standard therapies, as well as surgical intervention, may be applied in combination with the inventive cell therapy.

Chemotherapy

Cancer therapies also include a variety of combination therapies with both chemical and radiation based treatments. Combination chemotherapies include, for example, abraxane, altretamine, docetaxel, herceptin, methotrexate, novantrone, zoladex, cisplatin (CDDP), carboplatin, procarbazine, mechlorethamine, cyclophosphamide, camptothecin, ifosfamide, melphalan, chlorambucil, busulfan, nitrosurea, dactinomycin, daunorubicin, doxorubicin, bleomycin, plicomycin, mitomycin, etoposide (VP16), tamoxifen, raloxifene, estrogen receptor binding agents, taxol, gemcitabien, navelbine, farnesyl-protein tansferase inhibitors, transplatinum, 5-fluorouracil, vincristin, vinblastin and methotrexate, or any analog or derivative variant of the foregoing and also combinations thereof.

In specific embodiments, chemotherapy for the individual is employed in conjunction with the invention, for example before, during and/or after administration of the invention Radiotherapy Other factors that cause DNA damage and have been used extensively include what are commonly known as .gamma.-rays, X-rays, and/or the directed delivery of radioisotopes to tumor cells. Other forms of DNA damaging factors are also contemplated such as microwaves and UV-irradiation. It is most likely that all of these factors effect a broad range of damage on DNA, on the precursors of DNA, on the replication and repair of DNA, and on the assembly and maintenance of chromosomes. Dosage ranges for X-rays range from daily doses of 50 to 200 roentgens for prolonged periods of time (3 to 4 wk), to single doses of 2000 to 6000 roentgens. Dosage ranges for radioisotopes vary widely, and depend on the half-life of the isotope, the strength and type of radiation emitted, and the uptake by the neoplastic cells.

The terms "contacted" and "exposed," when applied to a cell, are used herein to describe the process by which a therapeutic construct and a chemotherapeutic or radiotherapeutic agent are delivered to a target cell or are placed in direct juxtaposition with the target cell. To achieve cell killing or stasis, both agents are delivered to a cell in a combined amount effective to kill the cell or prevent it from dividing.

Immunotherapy

Immunotherapeutics generally rely on the use of immune effector cells and molecules to target and destroy cancer cells. The immune effector may be, for example, an antibody specific for some marker on the surface of a tumor cell. The antibody alone may serve as an effector of therapy or it may recruit other cells to actually effect cell killing. The antibody also may be conjugated to a drug or toxin (chemotherapeutic, radionuclide, ricin A chain, cholera toxin, pertussis toxin, etc.) and serve merely as a targeting agent. Alternatively, the effector may be a lymphocyte carrying a surface molecule that interacts, either directly or indirectly, with a tumor cell target. Various effector cells include cytotoxic T cells and NK cells.

Immunotherapy other than the inventive therapy described herein could thus be used as part of a combined therapy, in conjunction with the present cell therapy. The general approach for combined therapy is discussed below. Generally, the tumor cell must bear some marker that is amenable to targeting, i.e., is not present on the majority of other cells. Many tumor markers exist and any of these may be suitable for targeting in the context of the present invention. Common tumor markers include PD-1, PD-L1, CTLA4, carcinoembryonic antigen, prostate specific antigen, urinary tumor associated antigen, fetal antigen, tyrosinase (p97), gp68, TAG-72, HMFG, Sialyl Lewis Antigen, MucA, MucB, PLAP, estrogen receptor, laminin receptor, erb B and p155.

Genes

In yet another embodiment, the secondary treatment is a gene therapy in which a therapeutic polynucleotide is administered before, after, or at the same time as the present invention clinical embodiments. A variety of expression products are encompassed within the invention, including inducers of cellular proliferation, inhibitors of cellular proliferation, or regulators of programmed cell death.

Surgery

Approximately 60% of persons with cancer will undergo surgery of some type, which includes preventative, diagnostic or staging, curative and palliative surgery. Curative surgery is a cancer treatment that may be used in conjunction with other therapies, such as the treatment of the present invention, chemotherapy, radiotherapy, hormonal therapy, gene therapy, immunotherapy and/or alternative therapies.

Curative surgery includes resection in which all or part of cancerous tissue is physically removed, excised, and/or destroyed. Tumor resection refers to physical removal of at least part of a tumor. In addition to tumor resection, treatment by surgery includes laser surgery, cryosurgery, electrosurgery, and miscopically controlled surgery (Mohs' surgery). It is further contemplated that the present invention may be used in conjunction with removal of superficial cancers, precancers, or incidental amounts of normal tissue.

Upon excision of part of all of cancerous cells, tissue, or tumor, a cavity may be formed in the body. Treatment may be accomplished by perfusion, direct injection or local application of the area with an additional anti-cancer therapy. Such treatment may be repeated, for example, every 1, 2, 3, 4, 5, 6, or 7 days, or every 1, 2, 3, 4, and 5 weeks or every 1, 2, 3, 4, 5, 6, 7, 8, 9, 10, 11, or 12 months. These treatments may be of varying dosages as well.

Other Agents

It is contemplated that other agents may be used in combination with the present invention to improve the therapeutic efficacy of treatment. These additional agents include immunomodulatory agents, agents that affect the upregulation of cell surface receptors and GAP junctions, cytostatic and differentiation agents, inhibitors of cell adhesion, or agents that increase the sensitivity of the hyperproliferative cells to apoptotic inducers. Immunomodulatory agents include tumor necrosis factor; interferon alpha, beta, and gamma; IL-2 and other cytokines; F42K and other cytokine analogs; or MIP-1, MIP-1beta, MCP-1, RANTES, and other chemokines. It is further contemplated that the upregulation of cell surface receptors or their ligands such as Fas/Fas ligand, DR4 or DR5/TRAIL would potentiate the apoptotic inducing abilities of the present invention by establishment of an autocrine or paracrine effect on hyperproliferative cells. Increases intercellular signaling by elevating the number of GAP junctions would increase the anti-hyperproliferative effects on the neighboring hyperproliferative cell population. In other embodiments, cytostatic or differentiation agents can be used in combination with the present invention to improve the anti-hyperproliferative efficacy of the treatments. Inhibitors of cell adhesion are contemplated to improve the efficacy of the present invention. Examples of cell adhesion inhibitors are focal adhesion kinase (FAKs) inhibitors and Lovastatin. It is further contemplated that other agents that increase the sensitivity of a hyperproliferative cell to apoptosis, such as the antibody c225, could be used in combination with the present invention to improve the treatment efficacy.

EXAMPLES

Example 1: Materials and Methods

Cells, culture media and reagents. Human CAIX+ renal cell carcinoma cell lines sk-rc-52, sk-rc-09 and CAIX− sk-rc-59 were obtained from Dr. Gerd Ritter, Memorial Sloan-Kettering Cancer Center, New York. They were cultured at 37° C. with 5% $CO_2$ in R-10 complete medium containing RPMI 1640 medium (Life Technologies) supplemented with 10% FCS, 2 mmol/L L-glutamine, 100 U/ml penicillin, and 100 μg/ml streptomycin (Sigma). Primary human T cells were maintained in R-10 with 10% human serum and 100 IU/ml recombinant human interleukin 2 (IL-2) (Chiron). Human embryonic kidney cell line 293T (ATCC) and mouse fibroblast NIH3T3 cells (ATCC) were grown in D-10 complete medium (Life Technologies) containing DMEM medium with 10% FCS, 100 U/ml penicillin, and 100 μg/ml streptomycin (Sigma). Leukopacks obtained from the blood bank of the Children's Hospital Boston were collected from healthy volunteers with written informed consent.

In one embodiment, Human ccRCC cell lines, Skrc52, originally CAIX+/PD-L1−, and Skrc59, originally CAIX−/PD-L1+, were obtained from Dr. Gerd Ritter (Memorial Sloan-Kettering Cancer Center, New York). These cells were cultivated in RPMI 1640 Medium (Life Technologies) supplemented with 10% (v/v) heat-inactivated fetal bovine serum (FBS, Gibco), 100 IU/ml penicillin and 100 μg/ml streptomycin. 293T (CRL-11268, ATCC) and Lenti-X 293T (Clontech) cells were grown in DMEM Medium (Life Technologies) supplemented with 10% FBS, 100 IU/ml penicillin and 100 μg/ml streptomycin. All cell lines used in this project were transduced with luciferase through lentiviral transduction and maintained at 37° C. with 5% CO2. The Skrc52 cells were selected for CAIX−/PD-L1− and CAIX+/PD-L1− cell populations by Fluorescence activated cell sorting (FACS) sorting. Skrc59 cells were engineered to express high levels of human CAIX and CAIX+/PD-L1+ were selected by FACS sorting.

Cloning of Anti-PD-L1 scFv-Fc IgG1 and IgG4 Into a Bicistronic Lentiviral Vector Encoding an Anti-CAIX $2^{nd}$ Generation CAR The anti-PD-L1 antibody (Ab) used to construct the CART cells was previously selected using a 27-billion-member human scFv phage display library against a full length PD-L1 in the form of paramagnetic proteoliposomes (manuscript in preparation). The DNA sequences that encoded the anti-PD-L1 scFv (Clone 42)-Fc IgG1 or IgG4 were codon optimized and synthesized (Genewiz) containing the restriction sites for 5' NdeI and 3' ClaI to allow further scFv-Fc cloning to replace ZsGreen in the lentiviral vector pHAGE-eIFα signal-scFvG36 (anti-CAIX)-C9TAG-linker-CD28-CD3ζ-IRES-ZsGreen (e.g. CD28z). This anti-CAIX original vector was previously constructed and published (21). For the cloning of the negative controls, firstly we replaced anti-PD-L1 scFv with an anti-Severe Acute Respiratory Syndrome (SARS) scFv (Clone 11A) in the IgG1-Fc lentiviral vector containing the anti-CAIX G36 scFv CAR. The DNA sequence that coded for the anti-SARS scFv was amplified by PCR from the plasmid pHAGE CMV-Anti-SARS (11A) scFv-Fc-CD28-gp41-IRES-ZsGreen to insert the restriction sites for 5' MluI and 3' XbaI for further cloning using the MluI forward primer 5' TCG ACG CGT GAG GTG CAG CTG GTG CAG T 3' (SEQ ID NO: 1679) and XbaI reverse primer 5' TCC TCT AGA CAG GAC GGT GAC CTT GGT CC 3' (SEQ ID NO: 1680). The final pHAGE-eIFα-scFv G36 (anti-CAIX)-C9TAG-linker-CD28-CD3ζ-IRES-anti-SARS (11A) IgG1 was used as one of the negative controls. We also replaced the anti-CAIX scFv in the CAR structure containing the anti-SARS IgG1 for the anti-B cell maturation antigen (BCMA) scFv by double digestion of the pHAGE-eIFα-A716scFv (anti-BCMA)-C9TAG-linker-CD28-CD3ζ-IRES-ZsGreen and the pHAGE-eIFα-G36scFv(anti-CAIX)-C9TAG-linker-CD28-CD3ζ-IRES-anti-SARS (11A) IgG1 with NcoI and NotI. After the cloning processes we obtained four main plasmids to start the Lentiviruses production: Anti-CAIX CAR able to express anti-PD-L1 IgG1 (anti-CAIX/anti-PD-L1 IgG1), anti-CAIX CAR able to express anti-PD-L1 IgG4 (anti-CAIX/anti-PD-L1 IgG4), anti-CAIX CAR able to express an irrelevant anti-SARS Ab (anti-CAIX/anti-SARS IgG1) and anti-BCMA CAR able to express an irrelevant anti-SARS Ab (anti-BCMA/anti-SARS IgG1).

scFv isolation and conversion of scFv to scFv-Fc. CAIX-specific scFv antibodies were isolated from a non-immune human scFv phage library as previously reported and submitted to GenBank with accession numbers of GQ903548-GQ903561[23]. scFv-coding DNA fragments from the pFarber phagemid were digested with SfiI/NotI sites and subcloned into the mammalian expression vector pcDNA3.1-F105L-hinge-stuffer which has a human IgG1 F105 leader sequence and the human IgG1 hinge-CH2-CH3 Fc portion to express scFv-Fc antibodies. Plasmids of scFv-Fc were transiently transfected into 293T cells by lipofectamine 2000 (Invitrogen), and expressed antibodies were purified using Sepharose protein A beads (Amersham Bioscience). Specific binding to CAIX was tested by staining with phage scFv antibodies or scFv converted into scFv-Fc format antibodies by incubation with CAIX-expressing 293T and sk-rc-52 cell lines, and with CAIX negative 293T and sk-rc-59 cell lines. In these experiments, irrelevant anti-HIV CCR5 antibody (clone A8)[25] or anti-SARS antibody (11A)[24] and fluorescently conjugated secondary antibodies alone were used as negative controls.

Construction of scFv-CD8-TCRζ and scFv-CD28-TCRζ constructs. Pz1, scFv-CD8-TCRζ, and P28z, scFv-CD28-TCRζ, DNA constructs in phagemid vector pSL1180 were obtained from Dr. Michel Sadelain, Memorial Sloan-Kettering Cancer Center, New York. In Pz1, the scFv and TCRζ intracellular domain are appended to N- and C-terminus of human CD8α chain, respectively. Similarly, in P28z, the scFv and TCRζ sequences are appended to the N- and C-terminus of human CD28, respectively. The amino acid sequence of human CD8α is 71 residues in length, consisting of 47 (aa 137-183), 23 (aa 184-206), and 2 (aa 207-208) residues of the CD8α extracellular and hinge, transmembrane, and cytoplasmic domains, respectively. The CD28 sequence in P28z is 107 residues in length, consisting of 40 (aa 114-153), 23 (aa 154-176), and 44 (aa 177-220) residues of the CD28 extracellular, transmembrane, and cytoplasmic domains respectively. The human CD3ζ intracellular domain common to both CARs consists of 112 amino acids (aa 52-163).

The nucleic acid sequence encoding an internal C9-tag (a nine-amino acid peptide of human rhodopsin, TETSQVAPA (SEQ ID NO: 1678)) with a GGGGS linker (SEQ ID NO: 1684) was amplified by PCR and was fused upstream with CD8-TCRζ and CD28-TCRζ sequences with 5' NotI site and 3' PacI sites. The primers used for cloning chimeric TCRζ constructs are 5' TAG GGC GCG GCC GCa acc gag acc agc cag gtg gcg ccc gcc GGG GGA GGA GGC AGC CCC ACC ACG ACG CCA GCG CCG CGA 3' (SEQ ID NO: 1682) (forward primer for CD8 construct where italic is the NotI site, upper case is the C9 tag sequence, and underlining indicates the GGGGS linker), 5' TAG GGC GCG GCC GCa acc gag acc agc cag gtg gcg ccc gcc GGC GGA GGA GGC AGC ATT GAA GTT ATG TAT CCT CCT CCT 3' (forward primer for CD28 construct) and reverse primer for both constructs CTA GCC TT AAT TAA, TTA GCG AGG AGG GGG CAG GGC CTG CAT (SEQ ID NO: 1683), italic is Pac I site. These DNA fragments encoded functional features which are arranged in accordance with the following sequence: NotI—C9tag (TETSQVQPQ (SEQ ID NO: 1686))—GGGGS (SEQ ID NO: 1684)—CD8 or CD28—TCRζ—PacI. ("TETSQVQPQGGGGS" is disclosed as SEQ ID NO: 1685) The chimeric TCR constructs tagged with internal C9 peptide were cloned into the pcDNA3.1-F105L-hinge stuffer vector containing anti-CXCR4 scFv-Fc, clone 48, using NotI and PacI restriction sites. This design allowed us to insert chimeric TCR receptor constructs to replace Fc portion fragment. Later, anti-CAIX scFv (clone G36) and anti-CCR5 scFv (clone A8, as irrelevant scFv control) antibody fragments were cloned to replace anti-CXCR4 scFv at SfiI/NotI sites to create CAIX-specific chimeric TCR constructs.

The lentivirus vector pHAGE-CMV-DsRed-IRES-Zs-Green, and four HIV helper plasmids pHDM-Hgpm2 (HIV gag-pol), pMD-tat, pRC/CMV-rev, and an Env VSV-G pseudotype were obtained from Dr. Richard Mulligan, of the Virus Production Core at The Harvard Gene Therapy Initiative in Boston. The CMV promoter in pHAGE-CMV-IRES-ZsGreen was replaced by an EF1α promoter derived from the pSIN lentivirus vector at SpeI/NotI sites. One of the 5 scFv-Fc antibodies, G36, which possess high affinity to CAIX+ cells and high ADCC only against CAIX+ tumor cells, was cloned into pHAGE-EF1α lentivirus vector at AscI/BamHI to replace the first cassette of the DsRed protein.

Production of lentivirus and transduction of human primary T cells. Lentivirus was produced by five plasmid transient transfection into 293T cells using lipofectamine 2000 as per the manufacturer's instructions (Invitrogen). Cells were prepared for 80% confluence in 15 cm Petri dishes (Nalge Nunc) and transfected with 30 μg of total plasmid DNA. The ratio of vector plasmids (pHDM-Hgpm2 (HIV gag-pol):pMD-tat:pRC/CMV-rev:Env VSV-G pseudotype) was 20:1:1:2. After changing to D-10 medium, virus supernatant was harvested on day 3, filtrated through a 0.45 μm filter, and concentrated by ultracentrifugation (Beckman Coulter, Fullerton, CA) for 90 minutes at 16,500 rpm (48,960×g, Beckman SW28 rotor) and 4° C. The virus pellets were resuspended in R-10 medium and kept frozen at −80° C.

In one embodiment, Lentiviruses were produced by transient transfection of five plasmids into 293T cells using Polyethyleneimine (PEI). Briefly, each 80% confluent 293T cells in 15 cm plate (Nalge Nunc) was transfected with 30 μg of total five plasmids, being 5 μg of each structural plasmid pHDH-Hgpm2 (HIV gag-pol), pMD-tat; pRC/CMV-rev and Env VSV-G, and 10 μg of the main plasmid codifying the CAR (anti-CAIX/anti-PD-L1 IgG1, anti-CAIX/anti-PD-L1 IgG4, anti-CAIX/anti SARS IgG1 or anti-BCMA/anti SARS IgG1). The virus supernatant was concentrated using Lenti-X Concentrator (Clontech), following the manufacturer instructions, and kept frozen at −80° C.

Human PBMCs were isolated by ficoll density gradient separation and were activated with 2 μg/ml PHA (Sigma) plus 100 IU/ml human IL-2 for 4 days. The cells were infected with two or three rounds of lentivirus transduction at multiplicity of infection (MOI) of 10-20 in the presence of 10 µg/ml DEAE. Three days after transduction, transduced T cells were collected for phenotypic and functional analyses in vitro, or were expanded for in vivo experiments.

Selection, activation and lentivector transduction of CD8+ T cells. Blood collars collected from healthy volunteers with written informed consent were obtained from the blood bank of the Brigham and Woman's Hospital (Boston, MA). The isolation of human peripheral blood mononuclear cells (PBMCs) was performed using Ficoll-Paque PLUS (GE Healthcare, NJ). The Dynabeads for CD8 Positive Isolation (Life Technologies) were used to isolate CD8 positive cells from PBMCs, which were cultured in RPMI 1640 medium (Life Technologies) with 10% heat inactivated fetal bovine serum, 20 mM HEPES, 100 IU/ml penicillin and 100 µg/ml streptomycin and 50 IU/mL of IL-21 (Peprotech) was added in the medium every 2 days. The assays performed to determine if IL-2 or IL-21 were the best cytokine to induce anti-CAIX CART cells proliferation were performed with 50 IU/mL of each cytokine. The CD8+ T cells were activated with Dynabeads Human T-Activator CD3/CD28 (Life Technologies) using a ratio of 1:1. The cells were transduced with the Lentiviruses at a multiplicity of infection of 20 and 10 µg/mL of Diethylaminoethyl. All the assays were performed in triplicate and using T cells from three different healthy donors.

Flow cytometric analysis. Transduction efficiency of human primary T cells was assessed by expression of a reporter gene (ZsGreen). The CAIX-Fc protein was expressed from a pcDNA3.1 plasmid that encoded amino acids 38-397 of CAIX followed by human IgG1 hinge, CH2 and CH3 domains, the CAIX signal peptide (aa 1-37) was replaced with Ig leader sequence. Expression of scFv(G250) on transduced T cells was tested by staining the cells with 1 µg CAIX-Fc protein, and then APC-conjugated mouse anti-human IgG antibody (Jackson ImmunoResearch). Additionally, expression of the internal rhodopsin nonapeptide (TETSQVAPA (SEQ ID NO: 1678)) C9 tag of the scFv domain of TCR constructs on transduced T cells was detected by staining with 5 µg mouse 1D4 antibody followed by APC-conjugated goat anti-mouse IgG antibody (Jackson ImmunoResearch). For analysis, the subsets of human cells in culture during clonal expansion experiment were stained with fluorescence conjugated mouse anti-human antibodies (Invitrogen) against CD3 (clone S4.1), CD4 (clone S3.5) or CD8 (clone 3B5). In all cell staining, five hundred thousand cells were stained with antibodies at recommended concentration according to company's instruction. The matched isotype control antibodies for each sample were used and the cells were analyzed using a FACSCalibur cytometer (Becton-Dickinson).

In one embodiment, transduction of 293T cells or CD8+ T cells was confirmed by FACS analysis of the anti-CAIX or anti-BCMA expression. The cells were stained with 10 µg/mL of human CAIX-Fc produced in our lab or human BCMA-mouse-Fc (AB Bioscience) and then developed with 1:250 APC-conjugated mouse anti-human IgG Ab (Southern Biotech) or goat-anti mouse IgG Ab (Biolegend), respectively. CountBright™ Absolute Counting Beads (Molecular Probes) was used for the proliferation and clonal expansion assays. All samples were analyzed with an LSR Fortessa or with a FACSCalibur (BD Bioscience) and data were analyzed using FlowJo software. To analyze the status of T cell exhaustion of the CART cells they were cultured in the presence of IL-21 50 U/mL (Peprotech) and Dynabeads Human T Activator CD3/CD28 for five days. After this period the CART cells were co-cultured with Skrc-59 CAIX+ PD-L1+ cells for 2 days in order to stimulate exhaustion. 1×106 CART cells from this assay and Tumor-infiltrating Lymphocytes (TIL) collected from the in vivo assay were stained with FITC-conjugated anti-human PD-1, PE-conjugated anti-human Tim3, PerCP/Cy5.5-conjugated anti-human Lag3 antibodies (Biolegend) and Pacific Blue-conjugated anti-human CD45 and and analyzed by FACS. To verify the expression levels of CAIX and PD-L1 in the different RCC cell lineages used in this project, we used 10 µg/mL of the anti-human CAIX mAb (Clone G36), produced in our laboratory, and 10 µg/mL of the biotinylated mouse anti-human PD-L1 (Biolegend). The primary antibodies were detected using 1:250 APC-conjugated anti-human Ab and PE-conjugated avidin, respectively, and analyzed by FACS.

ADCC and cytotoxicity assay of lentivirus transduced T cells. Cytotoxicity assays were performed using the DEL-FIA EuTDA Cytotoxicity kit (Perkin Elmer, Boston, MA) in accordance with the manufacturer's instructions. Briefly, target tumor cells were labeled with a fluorescent ligand (BATDA) for 30 minutes at 37° C. and 1×10$^4$ labeled cells were loaded per well in 96-well U-bottom plate. For antibody-dependent cellular cytotoxicity (ADCC) assay, a panel of anti-CAIX scFv-Fc antibodies or irrelevant scFv-Fc antibody at a concentration of 1 µg/ml or 5 µg/ml was added separately. The assay was set up with ratios of effector cells (human PBMC) to target cells (E:T) at 50:1, 25:1 and 12.5:1. For the T cell cytoxicity assay, different ratios of effector cells (nontransduced or transduced T cells) to target cells (E:T) were prepared (100:1, 50:1 and 25:1). The culture was incubated for 4 hours in humidified 5% $CO_2$ at 37° C. After the plate was spun for 5 minutes at 500×g, 20 µl of supernatant was transferred to a flat-bottom plate. 200 µl of Europium solution was added and the fluorescence released from the cells was read by fluorometer (Victor™, PerkinElmer). The control for spontaneous release was prepared by culturing the labeling cells only and the control for maximum release was made by adding lysis buffer (kit provided) to the labeling cells.

ELISA, ELISPOT assays and Western blot. For cytokine secretion, RCC cell lines sk-rc-52 (CAIX+) or sk-rc-59 (CAIX−) were seeded overnight at 1×10$^6$ per well in a 24-well plate, followed by 1×10$^6$ untransduced or transduced T cells. Before co-culture with tumor cells, T cells were washed with PBS twice to remove human IL-2. After overnight incubation, the supernatant was harvested and analyzed for IL-2 and IFN-γ by ELISA (e-Bioscience). In detecting T cells for the IFN-γ ELISPOT assay (e-Bioscience), a membrane was developed using AEC substrate solution and the number of spots was counted by ELISPOT plate reader (C.T.L. Cellular Technology).

For Western blot, preparation of untransduced and transduced T cells was described[50]. One million cells were prepared in non-reducing and reducing buffer (0.1 M dithiothreitol) and run on a 10-20% polyacrylamide gradient gel (Invitrogen). Proteins were transferred to polyvinylidene fluoride transfer membrane (NEN Life Science Products, Boston, MA) at 100 V, 4° C. overnight. The membrane was incubated with 1:2000 primary antibody, anti-human ζ-chain monoclonal antibody 8D3 (BD Pharmingen, San Diego, CA) and then with 1:3000 secondary antibody horseradish peroxidase (Caltag). Immunodetection was performed using the ECL Plus Western blotting detection system (GE Healthcare, Piscataway, NJ) and x-ray film exposure.

Detection of IgG secreted by CART cells using ELISA. The total level of IgG secreted to the medium of transduced cells was detected using Human IgG ELISA Quantitation Set (Bethyl Laboratories). The Anti-PD-L1 Abs secreted by transduced CD8+ CART Cells were purified with Protein A sepharose beads (GE Healthcare) and biotinylated using the EZ-Link Sulfo-NHS-LC-Biotin (Thermo Scientific). These antibodies were incubated with 5 µg/mL of human PD-L1 produced in the lab, which was pre-immobilized in Max-iSorp plates (Nunc) by 2 hours, RT. The biotinylated antibodies were detected by incubation with streptavidin-HRP for 1 h and developed with SureBlue™ TMB Peroxidase Substrate and TMB Stop Solution (KPL). The absorbance was read at $\lambda=450$ nm.

Proliferation, clonal expansion and cytokine secretion after tumor cell contact. Tumor cells were irradiated (3,000 rads) and seeded at $2.5\times10^5$ per well. T cells were added at $1\times10^6$ in culture medium containing R-10 plus 100 IU/ml human IL-2 for a week culture. T cells were split to maintain suitable density and re-stimulated with tumor cells weekly. The number of T cells was counted every 3 or 4 days for 2 weeks. The percentage expression of ZsGreen by transduced T cells and T cell subsets were determined weekly by fluorescence-activated cell sorting (FACS). For cytokine secretion studies after tumor cell contact, T cells that were in contact with irradiated tumor cells for one or two weeks were washed, incubated with fresh tumor cells overnight and culture supernatants were collected after 24 hrs for analysis. Clonal Expansion of CAIX+ CART Cells.

In one embodiment, Skrc52 CAIX+/PD-L1− and Skrc52 CAIX−/PD-L1− cells were irradiated with 3,000 rads and seeded at $2.5\times10^5$ per well. $1\times10^6$ T cells were added at the culture medium containing 50 IU/ml human IL-21 every two days. T cells were split to maintain suitable density and re-stimulated with tumor cells weekly. T cell number was counted once a week for 3 weeks by FACS.

Effect of anti-CAIX CART Cells Secreting anti-PD-L1 antibodies on RCC cells viability and antibody-dependent cellular cytotoxicity (ADCC). $2.5\times10^3$ Skrc59 CAIX+/PD-L1+ and Skrc52 CAIX−/PD-L1− were plated in 96 wells plate ON. Four days after the CART cells transduction they were added to the RCC cells in the 25:1, 50:1 and 100:1 ratio Effector cells:Tumor cells (E:T) and incubated ON. CART cells were removed and the viability of the tumor cells was assayed for MTT (Life Technologies). For the ADCC assay RCC cells were incubated for 1 hour, 37° C. with 50 µL of the CART cells supernatant adjusted for 500 ng/mL of the respective Ab Anti-PD-L1 IgG1, Anti-PD-L1 IgG4 or Anti-SARS IgG1. The cells were then incubated with 12.5:1, 25:1 or 50:1 NK cells for 4 h, 37° C., Lactate dehydrogenase (LDH) was measured in the supernatant by CytoTox 96® Non-Radioactive Cytotoxicity Assay (Promega).

ELISA assays to detect IL-2 and IL-2 and IFNγ released by functional CART cells. For analysis of cytokine secretion, $2.5\times10^3$ RCC cells Skrc59 CAIX+/PD-L1+ or Skrc52 CAIX−/PD-L1− were seeded in 96 wells plates ON, followed by 5:1, 25:1 and 50:1 CAR transduced T cells addition and incubation ON. The supernatant was removed and analyzed for IL-2 and IFNγ secretion using the Human IFNγ or Human IL-2 ELISA Ready-SET-Go Kit (eBioscience).

Orthotopic Renal Cell Carcinoma Model Establishment and CART-Cells Therapy. $5\times10^4$ passaged Skrc59 CAIX+/PD-L1+ cells were suspended in 10 µL of culture medium and diluted 1:1 in Matrigel™ (Life Technologies) and injected into the left subrenal capsule of 6-8 week-old male NSG mice (N=35). After a week, tumor implantation was confirmed by bioluminescence (BLI) image using a Xenogen IVIS imaging system (Life Technologies) and $1.0\times10^7$ of each CART cell (anti-BCMA CAR/anti-SARS IgG1, anti-CAIX CAR/anti SARS IgG1, anti-CAIX CAR/anti-PD-L1 IgG1 and anti-CAIX CAR/anti-PD-L1 IgG4) or untransduced T cells were injected intravenously in the tail vein (Day 0); N=6 mice per group. The tumor BLI was quantified after 7, 14, 23 and 30 days of CART cells injection. A second injection of $2.5\times10^6$ CAR or untransduced T cells was made on day 17. Mice were sacrificed at 30 days post tumor engraftment by standard CO2 inhalation, and tumors were harvested and weighted. The kidney tumors from all mice were divided in two equal parts and one of them was fragmented in small pieces and digested with collagenase 0.5 U/mL and DNAse 1.0 mg/mL to TIL extraction, which were analyzed for the expression of the exhaustion markers and the percentage of CART cells by FACS. The other part was fixed in 10% buffered formaldehyde, and submitted to immunohistochemistry for different markers. Two mice of each group were injected with $4.5\times10^6$ NK cells 2 days before the euthanasia. NK cells present in the tumor were stained with APC-Anti-CD56 Ab and analyzed by FACS. Animal experiments were performed in accordance with the guidelines of the DFCI Animal Care Committee.

Tumor establishment and T cell therapy. In one embodiment, due to immune-rejection of sk-rc-52 in 6-8 week-old female BALB/c nude mice and to accelerate in vivo growth properties, five million cells were subcutaneously inoculated into the mice, harvested, and expanded in vitro. The cell line was then passaged two more times in nude mice and the passaged cells were expanded for further experiments (subclone 4-1). For the therapeutic experiments, 5 million sk-rc-59 and 7.5 million passaged sk-rc-52 cells were subcutaneously inoculated on opposing flanks into nude mice to yield comparable tumor growth rates. After 7 days, tumors grew to the size of ~6 mm, and 50 million nontransduced or transduced T cells were injected intravenously. The mice were also treated with 20,000 IU human IL-2 by peritoneal injection every two days. Tumor size was measured by caliper in two dimensions and the mean of two tumor diameter was reported here. Animal experiments were performed in accordance with the guidelines of the Dana Farber Cancer Institute Animal Care Committee. Mice were sacrificed when tumors reached 15-mm diameter or 2,000 $mm^3$ and tumors were harvested.

Immunohistochemistry and immunofluorescence staining. For in vitro examination of transduced T cells, the cultured T cells were washed twice using PBS and resuspended in 2 µM Far Red DDAO-SE CellTrace dye (Molecular Probe) in PBS for 15 minutes at 37° C. Then the cells were washed with culture medium twice and cytospun on the glass slide. Far red pre-stained CART cells with ZsGreen coexpression were visualized using confocal microscopy (Zeiss) at the Optical Imaging Core facility, Harvard NeuroDiscovery Center.

To examine the killing effect of transduced T cells in tumor bed in situ, tumors were prepared for frozen sections for ApopTag Peroxidase In Situ Apoptosis Detection kit (Millipore). Cryosections were incubated with TdT enzyme (Millipore) for 1 hour. Rabbit anti-DIG (Dako) was added and incubated for 30 minutes and then Cy3-conjugated anti-rabbit antibody (Invitrogen) was added and incubated for 30 minutes. Sections were mounted with DAPI antifade mounting medium and fluorescent images were examined using confocal microscopy.

Xenograft tumors and mouse spleens were harvested, fixed in 10% formalin/PBS solution, and submitted to the Harvard Medical School, Rodent Histopathology Core Facility. Paraffin-embedded sections were dewaxed with xylene and rehydrated through graded alcohols before staining. Immunohistochemistry staining was performed by incubating with anti-human granzyme B antibody (Dako, clone GrB-7 (1:200)) as a primary antibody for 1 hour followed by secondary anti-rabbit antibody (Pierce) or anti-mouse antibody (Dako) for 30 minutes. Sections were developed using DAB substrate and counterstained with hematoxylin.

In one embodiment, the fixed tumors were paraffin-embedded, sectioned at four-micrometer, placed on slides and prepared for IHQ. The tissues were stained with the anti human: Ki67 (Vector, VP-K451), PD-L1 (Clone 405.9A11, produced in Dr. Gordon Freeman's lab), granzyme B (Abcam, ab4059) or NCAM (CD56) (Abcam, ab133345) antibodies, followed by secondary HRP conjugated anti-rabbit Ab or HRP-Avidin. The slides were developed using DAB and counterstained with hematoxylin. The images were obtained in an Olympus BX51 microscopy using a DP71 digital camera (Olympus) and analyzed in the DP Controller Software (Olympus). The image quantification was performed using the IHC Profiler Plugin of ImageJ Software as described in Varghese F, Bukhari A B, Malhotra R, De A. IHC Profiler: an open source plugin for the quantitative evaluation and automated scoring of immunohistochemistry images of human tissue samples. PloS one. 2014; 9:e96801.

Statistical Analyses.

Statistical significance was determined using the two-tailed Student's t-test.

The statistical analysis associated with FIGS. 16-23 are representative of at least three experiments unless otherwise noted. The statistical significance of the data was evaluated using ANOVA and Tukey posttest. $P<0.05$ was considered significant. The statistical analysis was performed using the IBM SPSS Statistics software version 20.

Figure 1B:
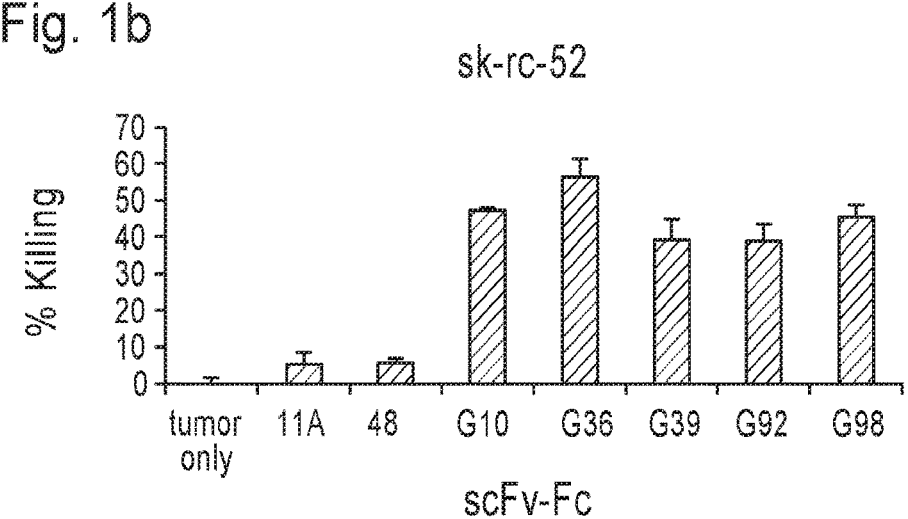
Figure 1C:
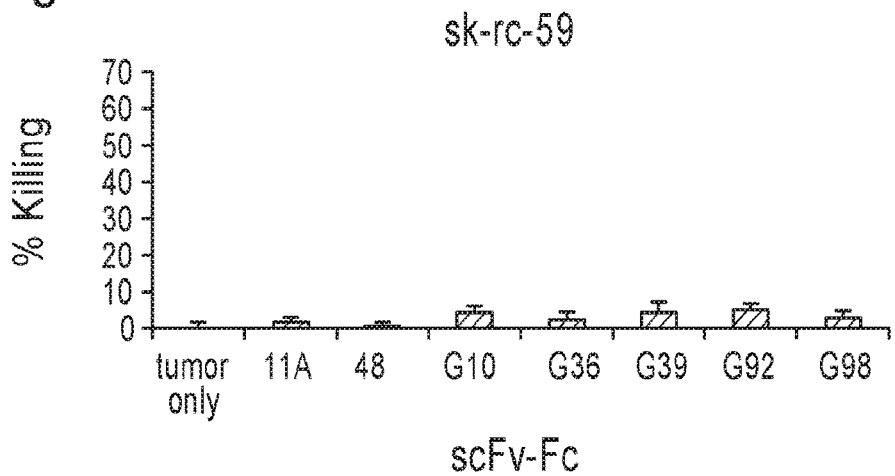

Example 2: ADCC Mediated Killing of Anti-CAIX Antibodies and Choice of CAR Targeting Moiety We have previously reported on a panel of high affinity human anti-CAIX antibodies that differed in their epitope mapping, expression levels and ability to internalize CAIX[23]. Our first aim was to investigate the anti-tumor activity of five of these anti-CAIX single-chain antibodies as candidates for CAR construction. To test for anti-CAIX mAb mediated ADCC, the scFvs were converted to scFv-Fc (hIgG1) minibodies[23]. We found that all scFv-Fcs exhibited antigen-specific tumor lysis. For tumor cell line sk-rc-09 with high CAIX+ expression, specific lysis ranged from 40-57% and for sk-rc-52 with moderate CAIX+ expression, specific lysis ranged from 46-60%, with background of lysis of <5% for the CAIX- tumor cell line sk-rc-59. For negative control scFv-Fcs such as anti-CXCR4 48-Fc[23] and anti-SARS 11A-Fc[24], only background levels of cell lysis were seen (FIG. 1). Based on ADCC killing and other published analyses, scFvG36 was chosen for further evaluation as the CAR targeting moiety.

Figure 2A:
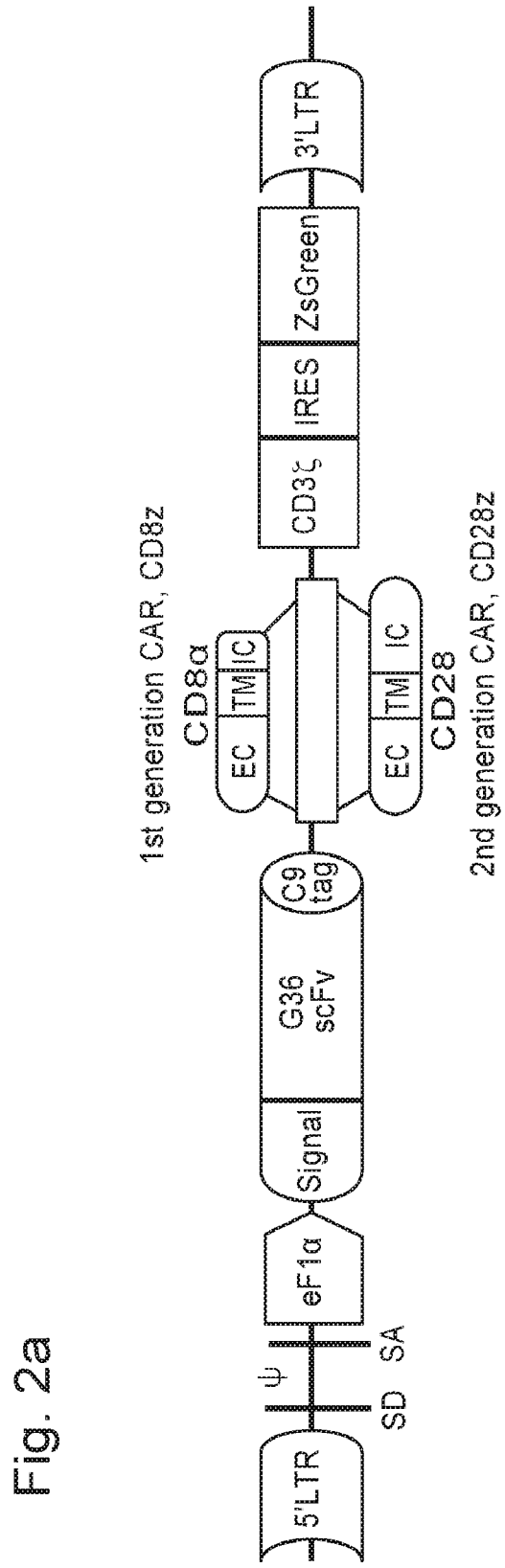
FIG. 2A-FIG. 2C. Construction and expression of CAIX-specific CARs.

Construction and expression of CAIX-specific chimeric receptors. Two generations of anti-CAIX CARs were constructed: 1$^{st}$ generation G36 CD8 CAR, with scFvG36 linked to CD8, truncated extracellular, hinge, and transmembrane domains plus signaling domain of TCRζ (G36-CD8z). To deliver costimulatory signals, 2$^{nd}$ generation CD28 CAR was generated, consisting of scFvG36 fused to truncated extracellular, transmembrane and intracellular domains of CD28 plus signaling domain of TCRζ (G36-CD28z) (FIG. 2A). Irrelevant 2$^{nd}$ generation CD28 CAR was made by using anti-HIV CCR5 (clone A8) scFv instead[25]. In order to detect the expression of these constructs, human rhodopsin C9 tag were inserted between the scFv and CD8 or CD28 domains, respectively and ZsGreen was expressed after the IRES sequence. High concentrations of viral stocks were obtained at comparable levels among the different constructs that were tested by cotransfection of vector plasmids into 293T cells (data not shown).

Figure 2B:
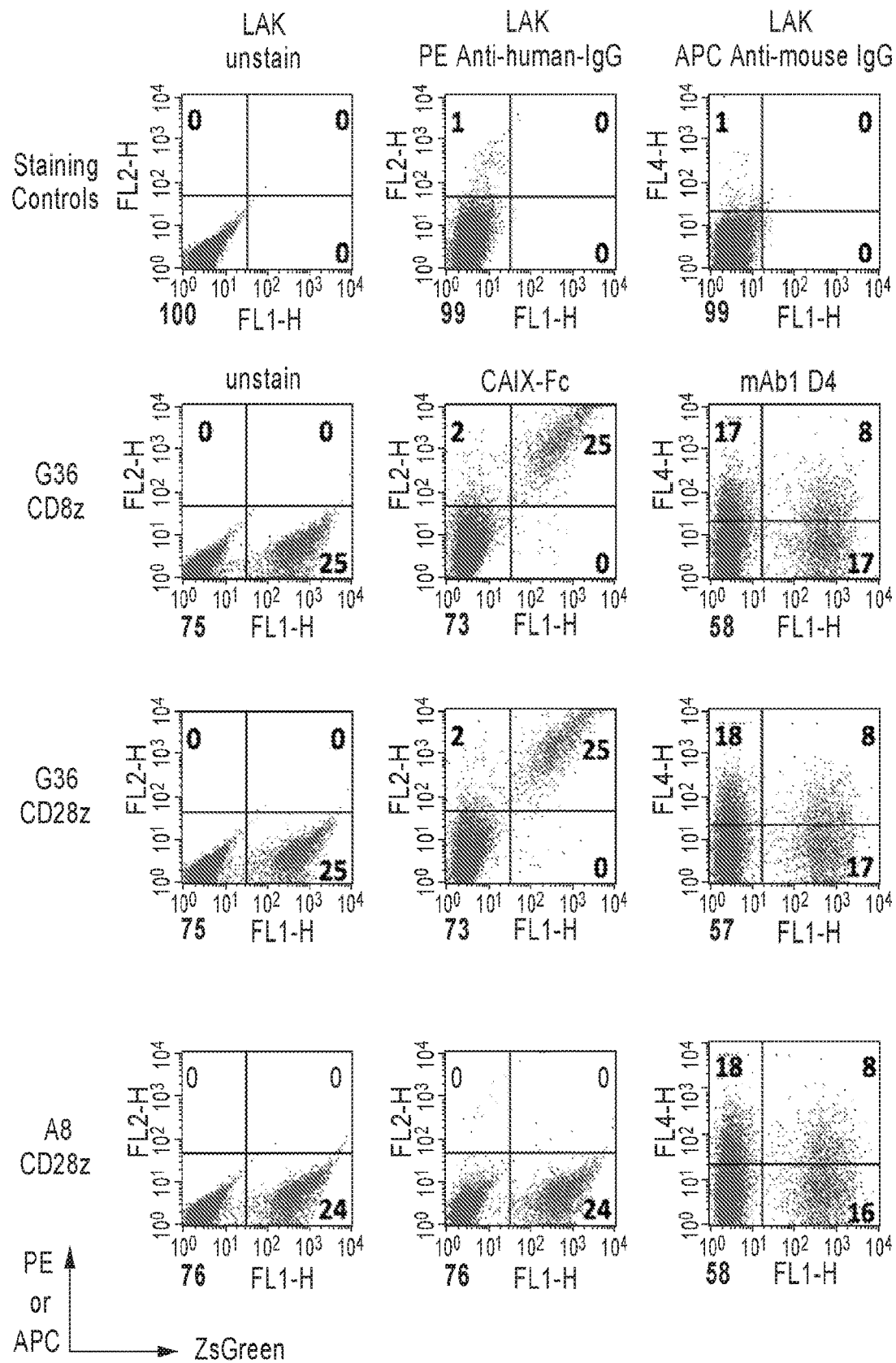

For transduction, PHA mitogen was used to stimulate peripheral blood lymphocytes for 3 days. Concentrated lentivirus supernatants were used to infect human primary T cells in the presence of cationic reagent DEAE as it increased the transduction rate of 1.5-2× fold as compared with polybrene (data not shown). The transduction rate of primary T cells ranged from 17% to 45% by ZsGreen expression in FACS analysis. A representative experiment showing ZsGreen expression in circa 25% by primary CART cells following lentivirus transduction is shown in FIG. 2B, left column CAIX-Fc fusion protein can bind to the G36-CD8z and -CD28z CART cells but not to control A8-CD28z CART cells (FIG. 2B, middle column). C9-tag expression was only detected at circa one-third the level of the CAIX-Fc protein (FIG. 2B, right column) which is likely related to the finding that mAb 1D4 preferentially recognizes the rhodopsin nonapeptide C9 when presented as a carboxy-terminal verses internal polypeptide sequence (data not shown). Transduced cells that were cultured in vitro for 6 weeks maintained their expression of ZsGreen.

Figure 2C:
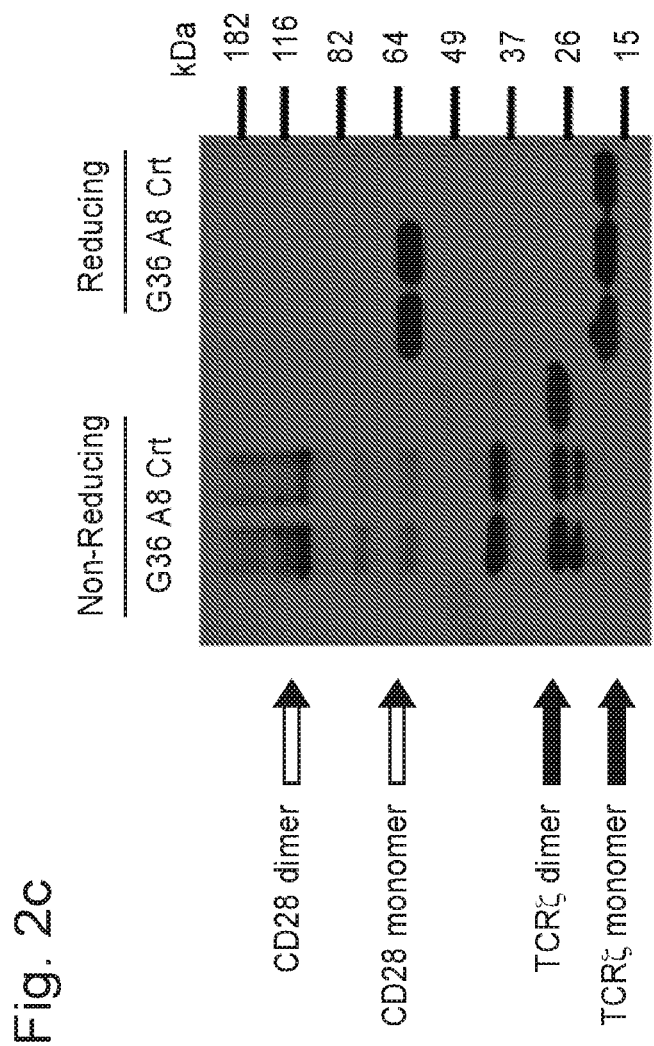

On Western blot under reducing conditions, G36 and A8 CD28z CARs migrated with a mol wt of circa 53 kD whereas endogenous TCRζ was 16 kDa. G36-CD8z CAR migrated with a mol wt of circa 48 kD. Under nonreducing conditions, these two CD28z CARs formed homodimers (FIG. 2C, data of CD8z CAR not shown).

Figure 3A:
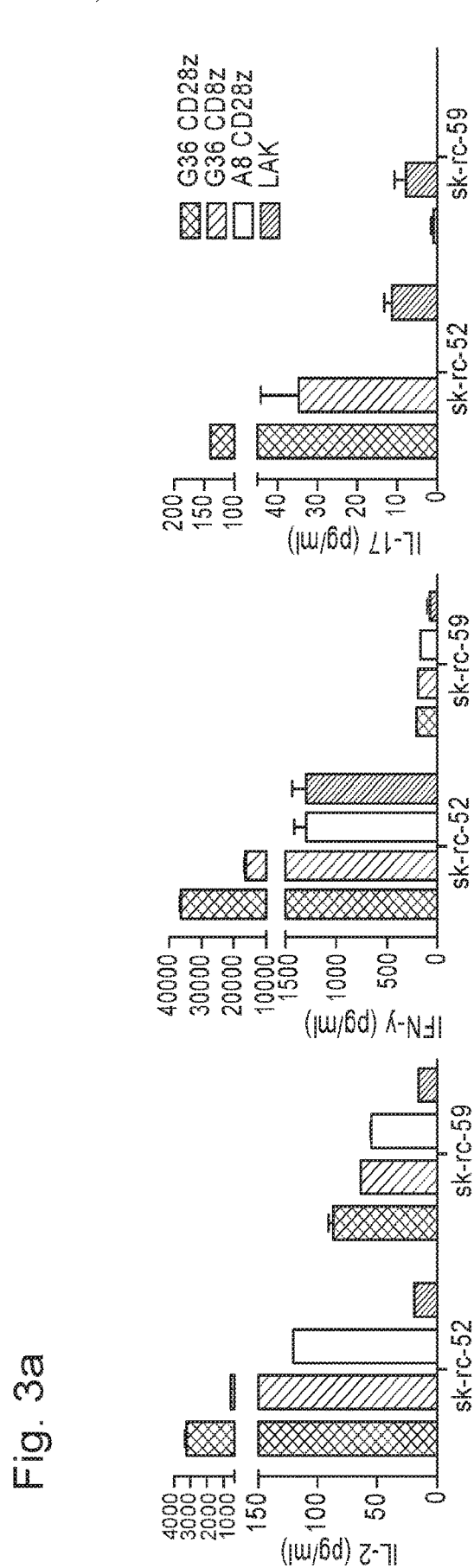

Example 3: Enhanced Cytokine Secretion by Transduced T Cells on Contact with CAIX+ Tumor A study was performed to compare the reported superior effects of using 2$^{nd}$ generation G36-CD28z CART cells that incorporate signaling components of the costimulatory molecule CD28 to bypass MHC presentation and enhance T cell effector functions verses 1$^{st}$ generation G36-CD8z CART cells. As seen in FIG. 3A, after incubation with CAIX+ sk-rc-52 cells overnight, only low levels of type I cytokines IL-2, IFNγ and IL-17 secretion were seen with control A8 CD28z CART cells or LAK cells alone. In contrast, both 1$^{st}$ and 2$^{nd}$ generation G36 expressing CART cells showed elevated levels of cytokine secretion with 2$^{nd}$ generation G36-CD28z CART cells secreting higher amounts of type I cytokines which reflects their higher activation status compared to 1$^{st}$ generation G36-CD8z CART cells. Specifically, G36-CD28z CART cells secreted 6.5×, 2.3× and 4× more IL-2, IFNγ and IL-17, respectively than G36-CD8z CART cells. Specificity of cytokine secretion induction by the two G36 CART cells is seen by their minimal stimulation with CAIX- sk-rc-59 cells.

In an Elispot study, after interaction with CAIX+ sk-rc-52 tumors, G36-CD28z CART cells became high capacity IFN-γ producing cells (FIG. 3B). G36-CD28z CART cells produced 6 times more spots than seen for G36-CD8z CART cells upon interaction with CAIX+ sk-rc 52 tumor cells and 12 times more spots than seen after interaction with CAIX- sk-rc-59 tumor cells. Similarly, G36-CD28z CART cells had a higher amount of granzyme B-secreting spots after contact with CAIX+ tumors as compared with G36-CD8z CART cells and control T cells. PMA and ionomycin stimulated T cells yielded the highest amount of IFN-γ and granzyme B secreting T cells. These studies demonstrate both specificity and high capacity of G36-CD28z CART cells to be activated by contact with CAIX+ tumor cells.

Example 4: Specific Cytotoxicity Via CAR Signaling in Transduced T Cells

An in vitro cytotoxicity assay was established to further evaluate the killing activity of the different G36 CART cells. Using different ratios of effector-to-target, G36-CD28z CART cells and its' twice in vivo passaged subclone 4-1 exhibited the highest amount of cytolysis of CAIX+ tumor sk-rc-52 (FIG. 3C). With high ratio of more than 25:1, G36-CD28z CART cells showed 2-3 fold higher cytotoxicity than G36-CD8z CART cells and with low ratio of 5:1, G36-CD28z CART cells showed 8-9 fold higher lysis than G36-CD8z CART cells. However, G36-CD8z CART cells still exhibited good cytotoxicity with up to more than 60% tumor lysis using 100:1 of E:T ratio. Irrelevant A8-CD28z CART cells and control T cell LAK showed the background non-specific tumor lysis with around 20% lysis when using the highest 100:1 of E:T ratio. In all cases of using CAIX− tumor sk-rc-59, transduced and untransduced T cells showed background lysis.

Figure 4A:
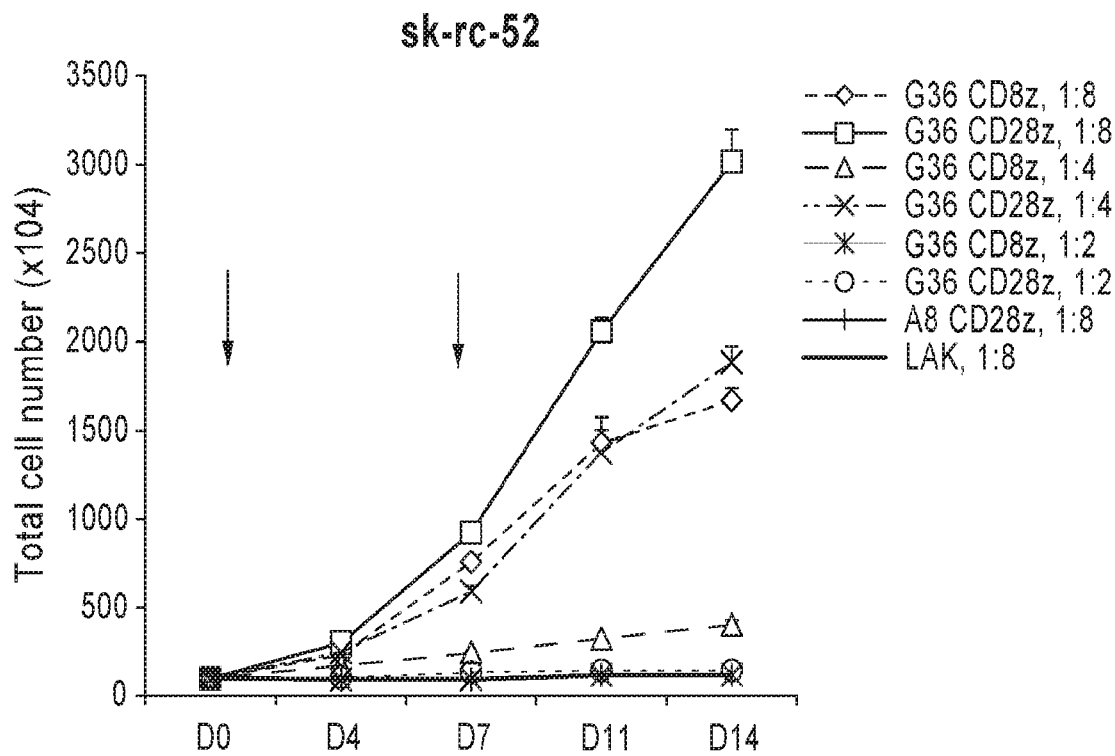
FIG. 4A, FIG. 4B and FIG. 4C. Clonal expansion of CART cells after tumor contact. A. Proliferation. CAR-transduced T cells or untransduced T cells (LAK) were plated with irradiated tumor cells (CAIX+ sk-rc-52 & CAIX− sk-rc-59) weekly at three different ratios of tumor to T cells as indicated. Number of T cells was counted every 3-4 days in triplicate from two separate wells. Similar results were obtained in two experiments. B. Clonal enrichment. In tumor stimulation experiments, cultures from CART- and LAK cells were assayed on one week and two weeks by flow cytometry for expression of CART and T-cell subset. One representative of two results is shown.
Figure 4A:
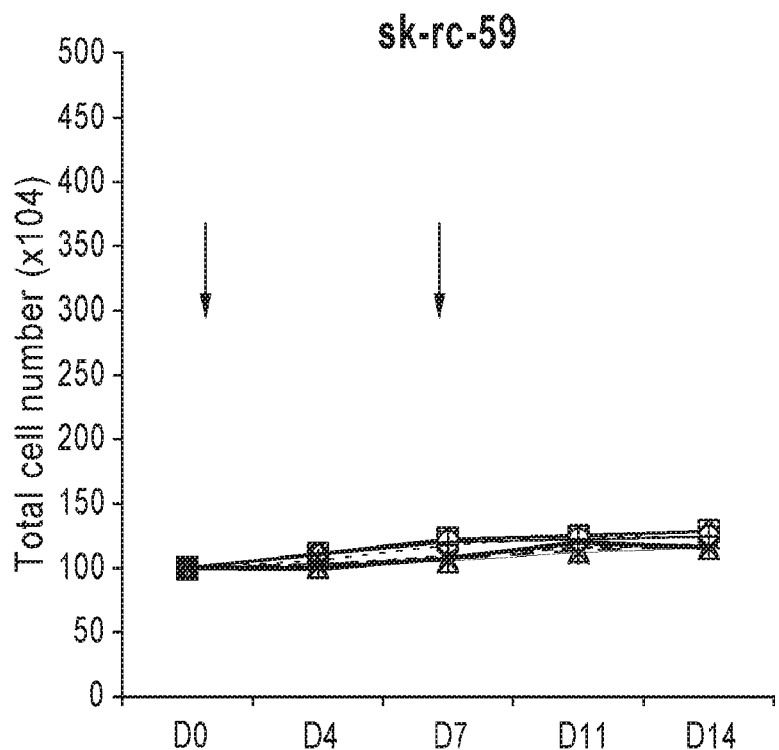

Example 5: Improved In Vitro Proliferation in Cart Cells with Prolonged CAIX+ Tumor Besides enhanced cytokine secretion and cytotoxicity on short term CAIX+ tumor cell contact, incorporation of the CD28 costimulatory molecule into the CAR construct demonstrated improved proliferation upon prolonged contact with antigen-specific tumor cells. Untransduced and transduced (around 20%) T cells were mixed with freshly irradiated tumor cells weekly in the presence of 100 units/ml human IL-2. To test the different levels of antigen stimulation to a fixed amount of T cells, we used tumor cell to T cell ratios of 1:8, 1:4 and 1:2. T cell numbers were counted by trypan exclusion and CART cell fractions were examined by flow cytometry. Under culture with CAIX− sk-rc-59 tumor cells, the number of transduced and untransduced T cells was maintained (FIG. 4A bottom). The lack of basal level of proliferation of control T cells might be due to the high amount of suppressive cytokines secreted by the tumor cell line. In contrast, after two weeks of culture with CAIX+ sk-rc-52 tumor cells, at ratio 1:8, the population of G36-CD28z CART cells increased to 30-fold and G36-CD8z CART cells proliferated up to 17-fold whereas at a ratio of 1:4, the number of G36-CD28z CART cells increased 19-fold and G36-CD8z CART cells proliferated 4-fold. With higher amounts of tumor cells, neither G36-CD28z or G36-CD8z CART cells could proliferate. Irrelevant A8-CD28z CART cells and control T cell LAK showed no proliferation with tumor cells (FIG. 4A top).

Figure 4B:
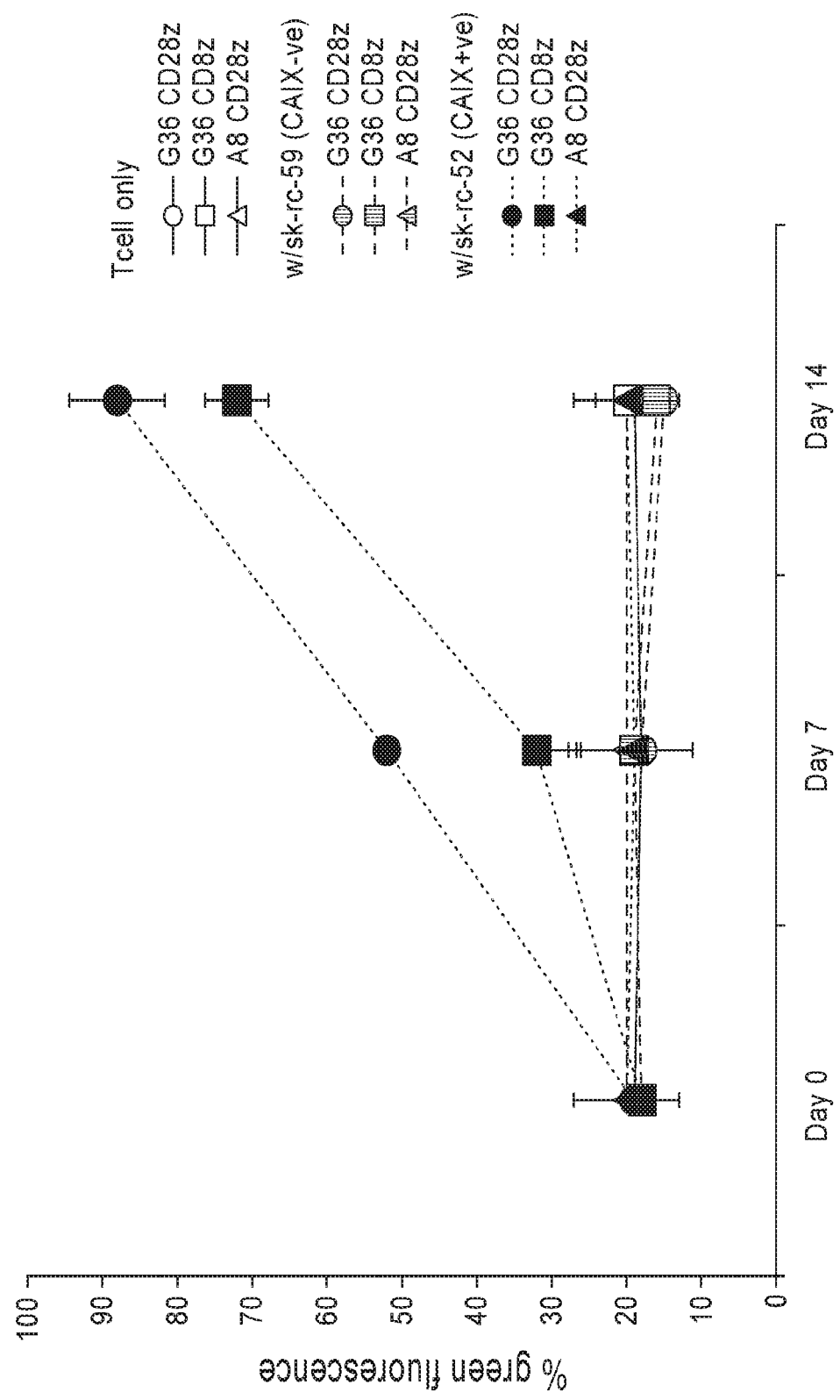
Figure 4C:
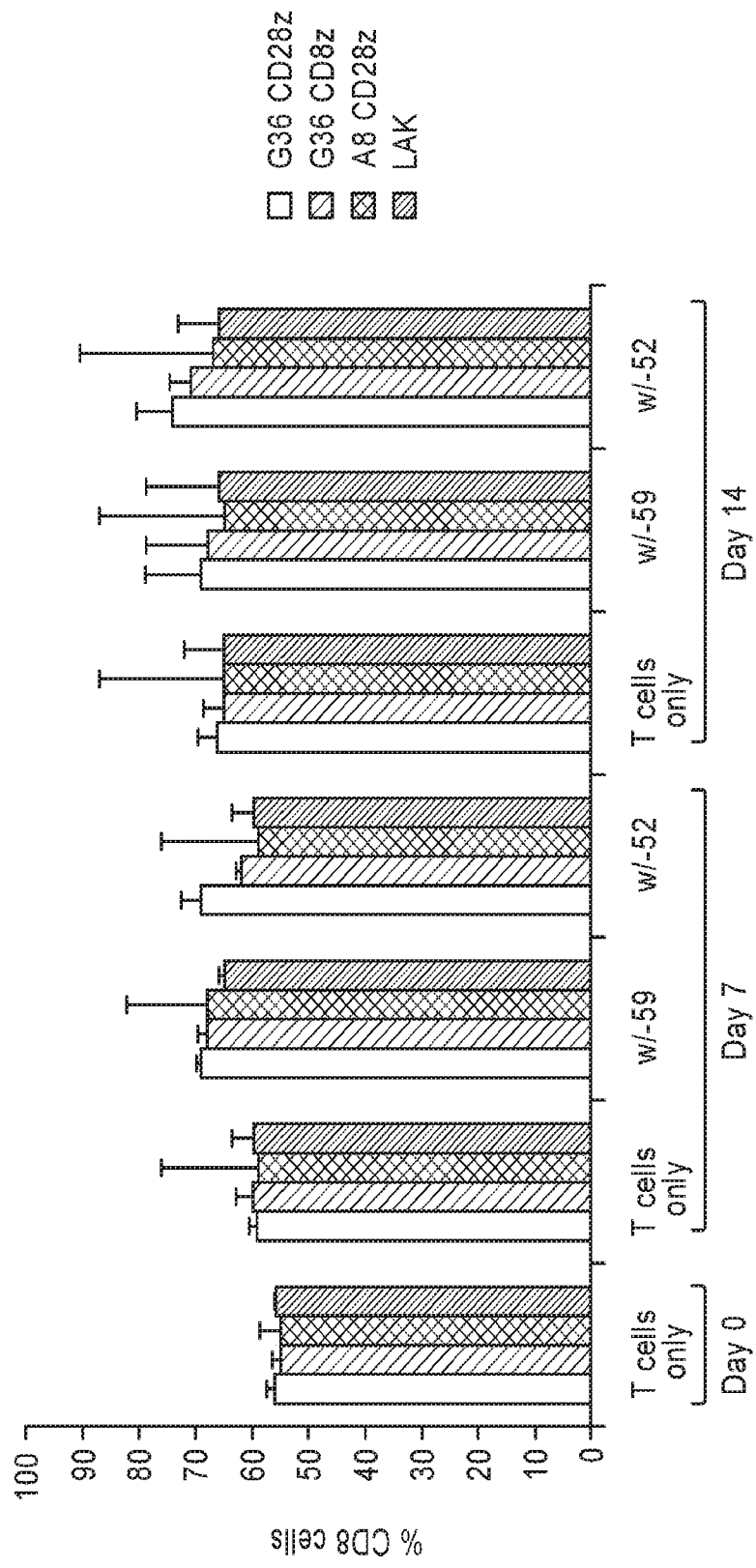

Proliferating T cells were also harvested to examine their enrichment on CAIX+ tumor cell contact. On CAIX− tumor contact, there was no change in the percentage of any CART cells within the population. However on contact with CAIX+ sk-rc-52 tumor cells, there was enrichment in both populations of G36 CART cells. For G36-CD28z CART cells, the positive population was enriched from 18% on day 0 to 52% on day 8 to 88% on day 16. Expression of G36-CD8z CART cells was enriched from 19% on day 0 (same levels at T cells only) to 32% on day 8, and to 72% on day 16. No expansion of A8-CD28z CART cells was seen over the two week study (FIG. 4B). The percentage of CD8 cells remained constant throughout the 16 day study under all conditions (FIG. 4C).

Example 6: Persistent Effector Function of Cart Cells After Re-Contact with Tumor Transduced T cells that were in contact with irradiated tumor cells for one or two weeks were also tested for cytokine secretion after 24 hours of contact with fresh non-irradiated tumor cells. Upon contact with CAIX+ tumor (sk-rc-52) for one or two weeks, G36-CD28z and G36-CD8z CART cells showed similar IFN-γ secretion levels although costimulatory signaling through G36-CD28z CAR yielding 2× to 2.5× more IFN-γ secretion than seen for G36-CD8z CAR (Table 1). For IL-2 secretion, two weeks of tumor contact for G36-CD28z and G36-CD8z CART cells exhibited more IL-2 secretion than one week of contact. G36-CD28z CART cells yielding 5× more IL2 than G36-CD8z CART cell on one week of contact and 2.5× more on contact for two weeks. In addition, G36-CD28z CART cells in contact with tumor cells for two weeks secreted 3.3× more IL-2 than one time tumor contact whereas G36-CD8z CART gave 6.8× more IL-2 secretion after two weeks compared to after one week of tumor contact. These results indicate that the transduced CART cells did not become exhausted and maintained functional activity after a second tumor stimulation. Only background levels of INF-γ and IL-2 secretion were seen with A8-CD28z, LAK and G36 CART cell treatments on contact with CAIX− sk-rc59 cells.

Example 7: Suppression of Established Tumor by CART Cells

We next tested CART cells to inhibit established tumor cell growth in nude mice that were inoculated with sk-rc-52 tumor cells on left flank and sk-rc-59 tumor cells on right flank that had been established to yield similar tumor curves. On day 7 after tumor implantation, with typical tumor size of ~6×6 mm, 50 million G36-CD28z CART cells, A8-CD28z CART cell or untransduced T cells (LAK) were injected intravenously. Adoptive T-cell therapy was performed in two separate experiments with group sizes of n=7 in the first trial and n=8 in the second trial, in the presence of high dose IL-2 ($2\times10^5$ IU) via intraperitoneal injection. No T-cell treatment was included in order to compare the growth of tumor and the effect of cell-therapy.

Figure 5:
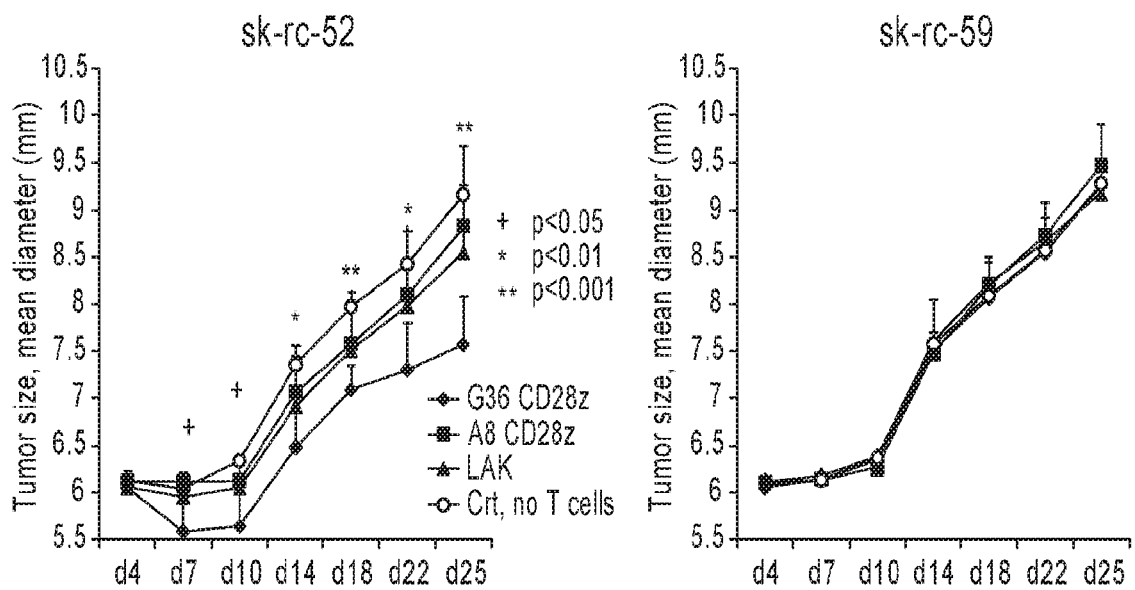
FIG. 5. Regression of established human RCC xenografts by CART cells. Athymic null mice were inoculated subcutaneously with $7.5 \times 10^6$ sk-rc-52 and $5 \times 10^6$ sk-rc-59 RCC tumor cells at left and right flank respectively. After 6 days of tumor implantation, mice were injected i.v. with $50 \times 10^6$ G36 CD28 CART cells, A8 CD28 CART cells (≥20% CAR+), LAK, or PBS alone. High dose of IL-2 ($1 \times 10^5$ U/ml) was injected every 2-3 days. Tumor size was measured by caliper every 2-3 days. Experiment 1, n=7 & Experiment 2, n=8. Tumor size of these two experiments was shown separately. +, p<0.05; *, p<0.01; **, p<0.001 in groups of G36 Tandem treated mice versus control no T cell treated mice in these two trials. Other statistic calculations are reported in the text.
Figure 5:
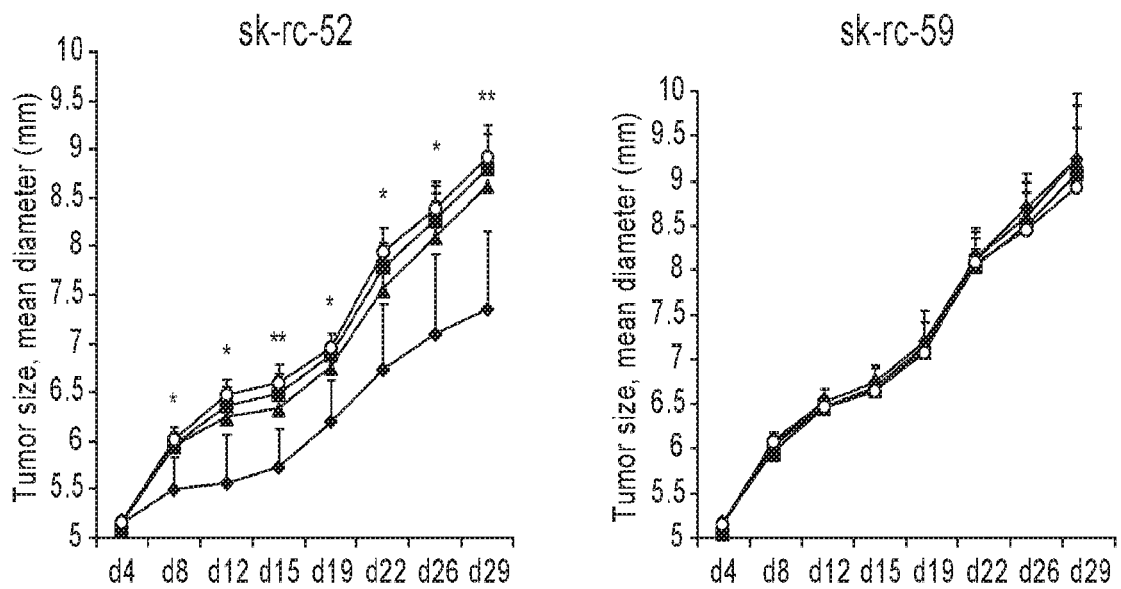

In trial one, treated and untreated CAIX− sk-rc-59 tumors had average size of 6.09±0.02 mm on day 4 and 9.29±0.12 mm on day 25 (within four tested groups). They exhibited the same tumor growth rate in control groups and T-cell treated groups. Untreated CAIX+ tumors that received no T cells showed similar tumor size as CAIX− tumors, with an average size of 6.09±0.13 mm on day 4 and 9.15±0.11 mm on day 25. However, the tumor size of G36-CD28z CART cell treated mice showed statistically significant reduction in size compared to no T-cell treated mice at every time point that was examined over the 25 day study (FIG. 5). G36-CD28z CART treatment also led to a greater reduction in tumor size than seen with A8-CD28z CART cell and LAK treated mice on day 7 (p<0.05) and on day 25 (p<0.001), as calculated by two-tailed t test. In trial two, tumor size of G36-CD28z CART cell treated mice was significant smaller than that of no T-cell treated mice through the 29 day experiment. G36-CD28z CART cell treated mice also had smaller tumors than were seen with A8 CD28z CART cell and LAK treated mice on day 8 to day 26 with p<0.01 and on day 29 with p<0.001 (FIG. 5).

Partial regression of CAIX+ tumor was considered when the tumor size was smaller than 30% volume of control CAIX− tumor in a same mouse receiving the same T-cell.

Partial tumor regression was observed in a high percentage of cases using G36-CD28z CART cells (10 out of 15, (67%)), but only infrequently in irrelevant target A8-CD28z CART cells (1 out of 15, (7%)) and in activated T cell LAKs (2 out of 15, (13%)) (Table 2). Frequency of partial regression response was found to be statistically significant for mice treated with G36-CD28z CART cells versus control A8-CD28z CART cells and LAKs at p<0.001 and p<0.005, respectively by Fisher test.

Example 8: In Situ Cytotoxicity by CART Cells

A sample of the whole population of transduced T cells used for the in vivo study were pre-stained with Far red dye and the CART cells expressing ZsGreen protein within the population were analyzed by confocal microscopy. These results demonstrated circa 30% transduction efficiency which is in agreement with our FACS analysis (FIG. 6A).

Figure 6B:
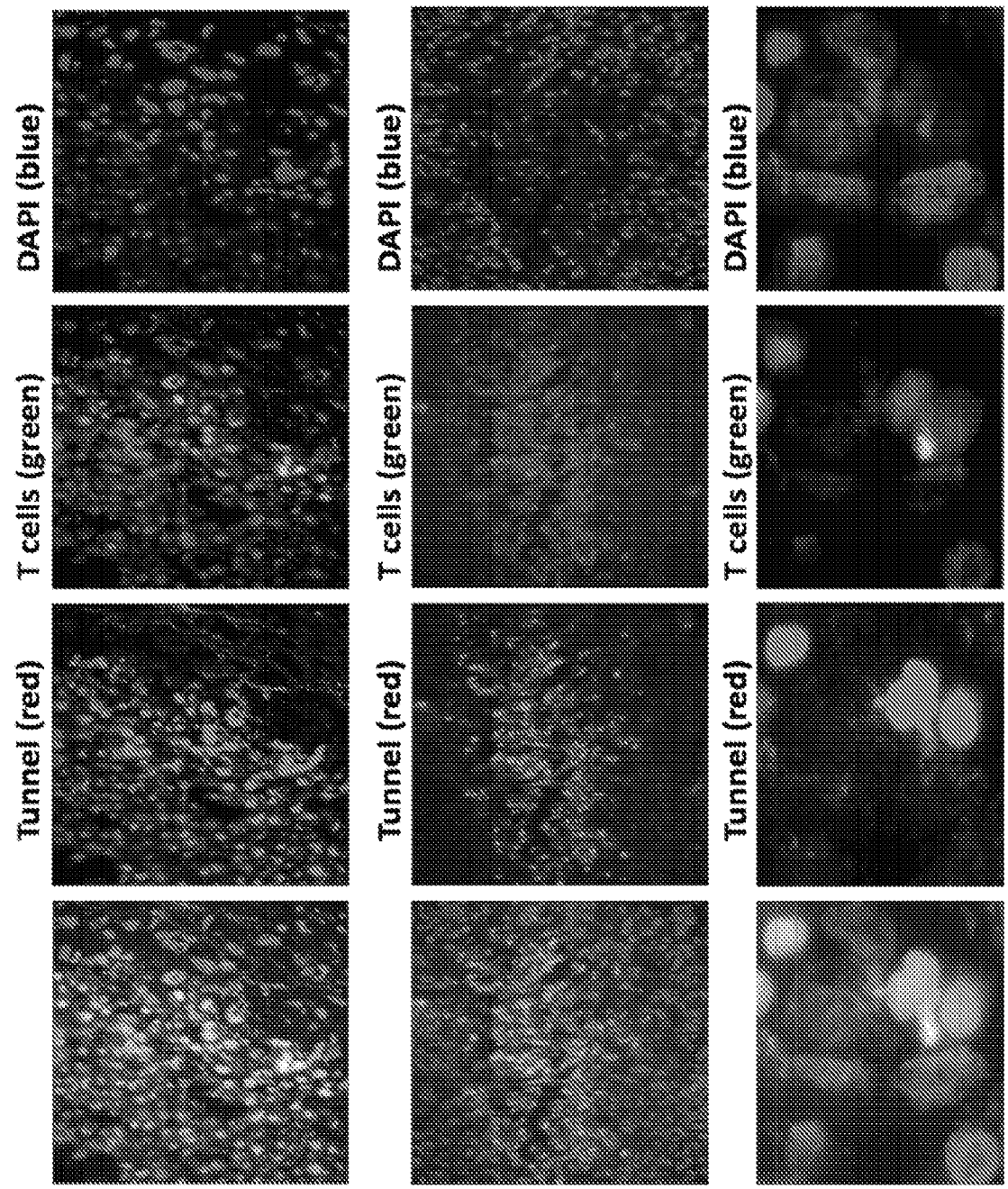

To provide evidence that G36-CD28z CART cell treatment of CAIX+ sk-rc-52 tumor cells in vivo resulted in killing by apoptosis, tumor sections were stained by Tunnel assay. On day 3 after adoptive T cell treatment, Tunnel staining identified apoptotic tumor cells (red) at the edge of tumor (FIG. 6B upper row) and inside the tumor bed (FIG. 6B middle row). The apoptotic tumor cells lost the DAPI nuclear staining. Shown in the enlarged graph (FIG. 6B bottom row) is a ZsGreen expressing CART cell interacting with two tumor cells that were going apoptosis.

Figure 6C:
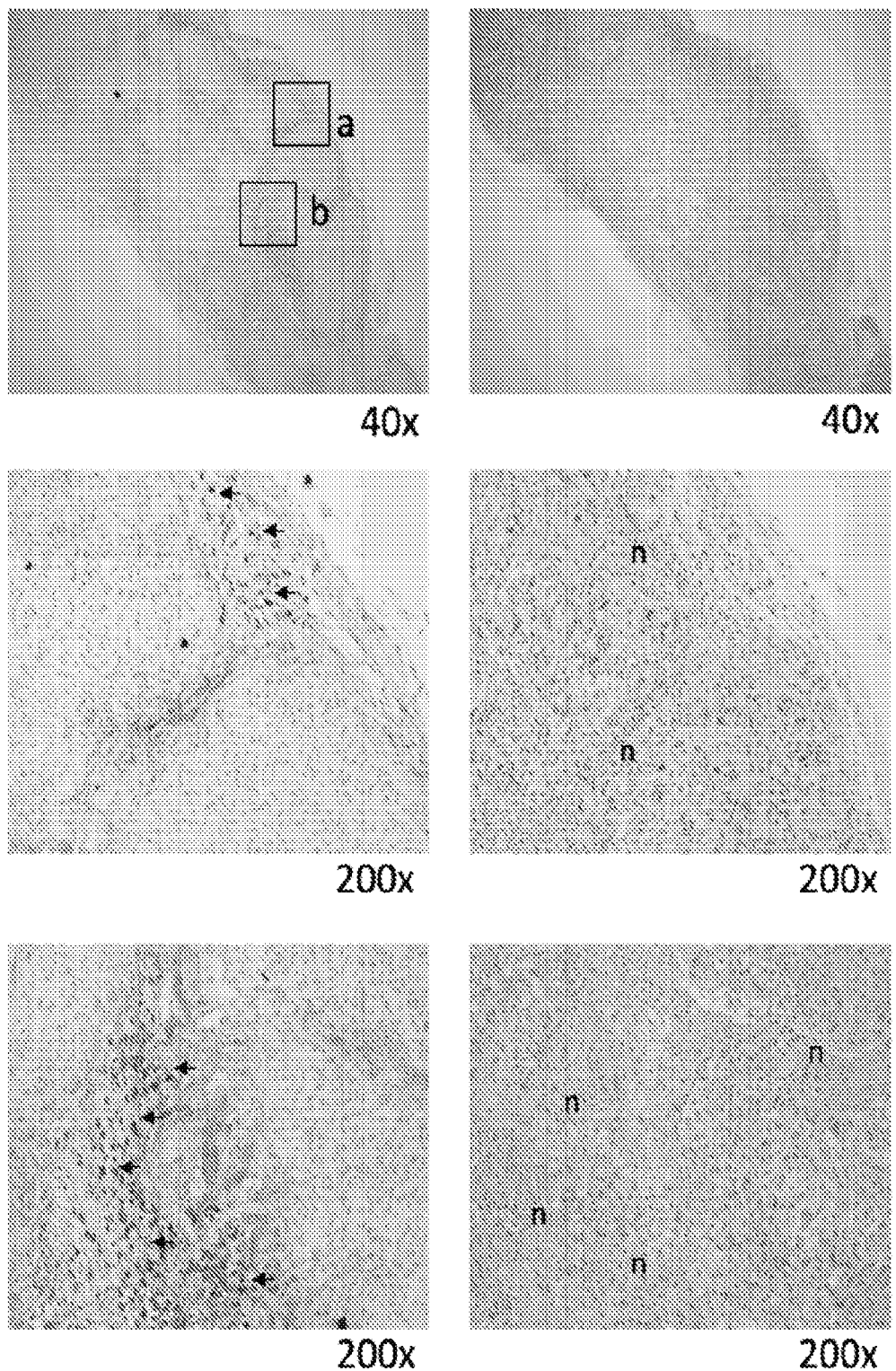
Figure 7:
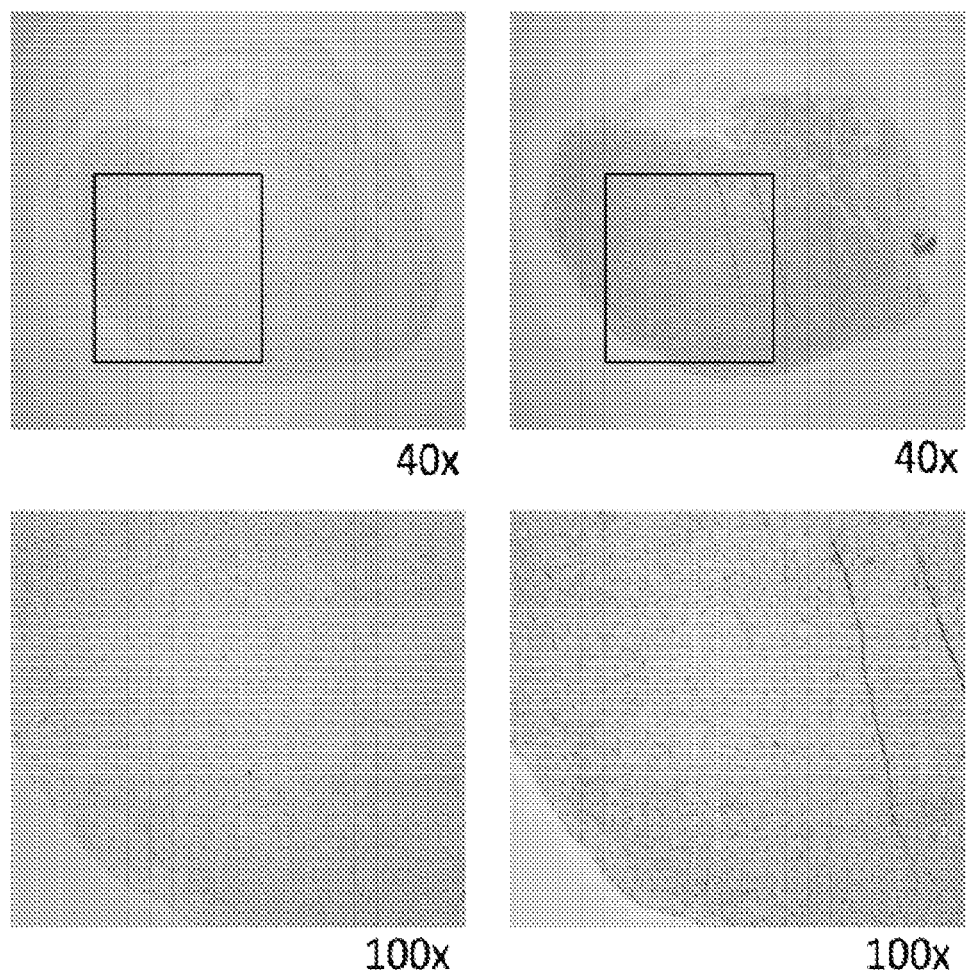
FIG. 7. CAIX− sk-rc-52 tumors treated with control LAK cells showed negative granzyme B staining (left) (upper panel) and the corresponding histology was shown in H&E (right).
Figure 8:
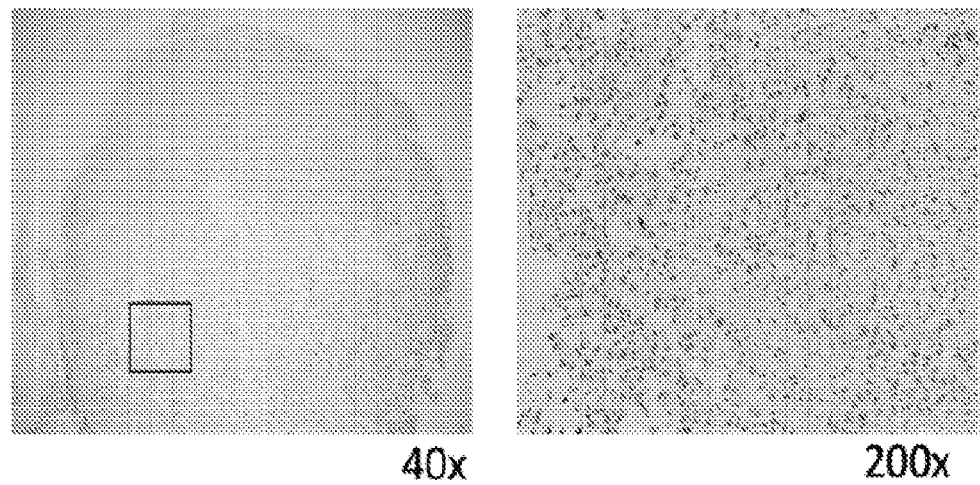
FIG. 8. Low background staining of granzyme B in CAIX− sk-rc-59 tumors treated with G36 CD28z CART cells FIG. 9. Low background staining of granzyme B in CAIX− sk-rc-59 tumors treated with LAK cells.
Figure 9:
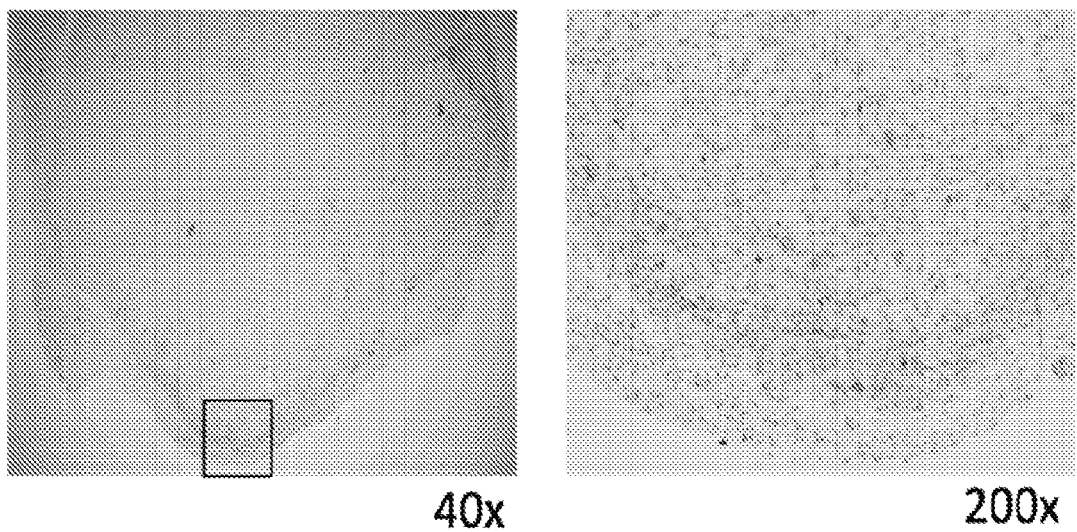
Figure 10:
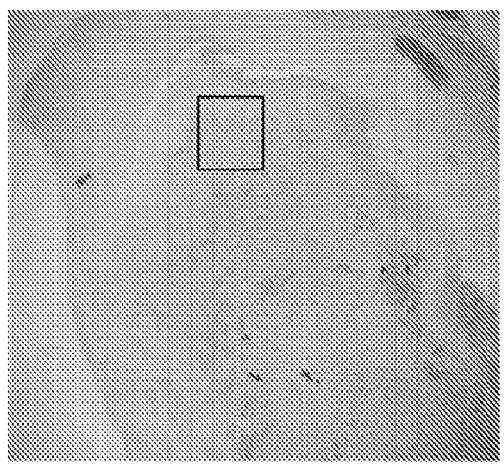
FIG. 10. Positive control of granzyme B staining was performed on sk-rc-52 tumors which was local injected with G36 CD28z CART cells (left) and tumor morphology was shown in H&E (right).
Figure 10:
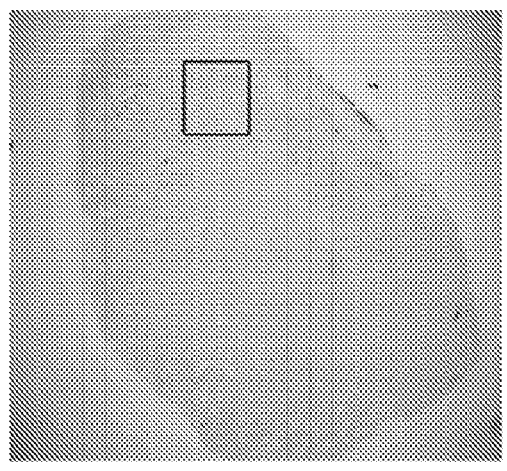
Figure 10:
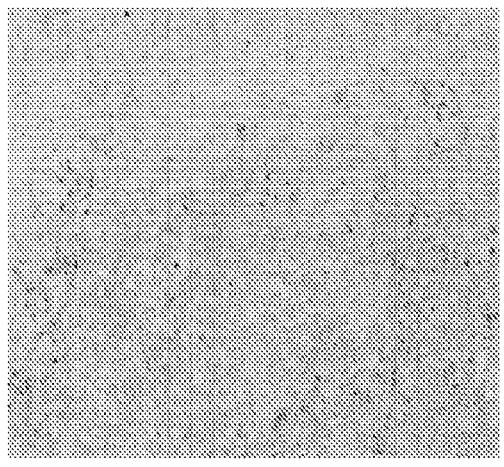
Figure 10:
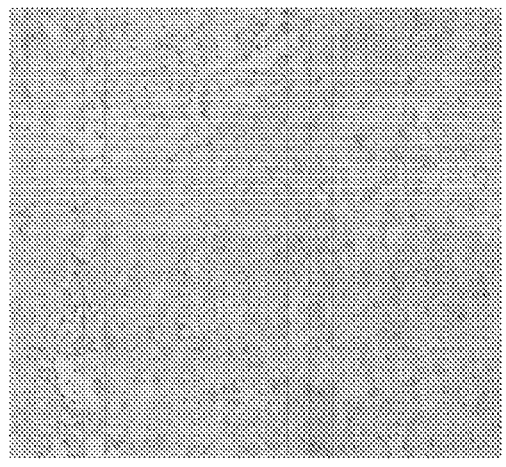
Figure 11:
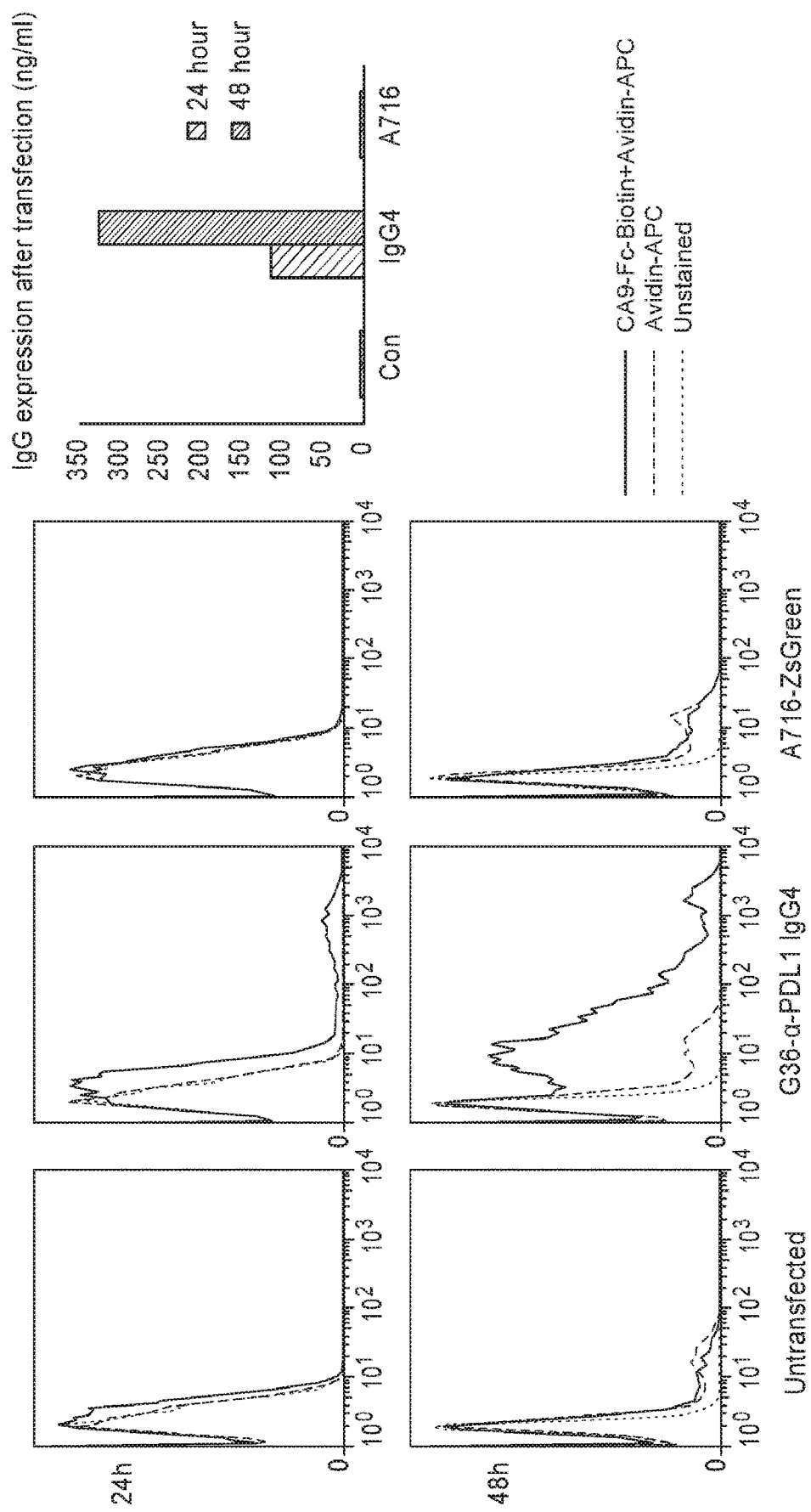
FIG. 11 Expression of αCAIX CAR and αPD-L1 scFv-Fc transiently transfected 293T cells. $10^6$ of 293T cells were transfected with or without lentiviral pHAGE-EF1αG36-C9tag-CD28-CD3zeta-IRES-anti-PDL1 scFv-Fc (IgG4)-WPRE or the control pHAGE-EF1α-A716-C9tag-CD28-CD3zeta-IRES-ZsGreen-WPRE plasmids. Cells and supernatant were harvested at 24 and 48 hours post transfection. Left, purified CAIX(ECD)-Fc-Biotin and Streptavidin-APC were used for cell staining and flow cytometry analysis. Right, total human IgG in supernatant was quantitated with human IgG quantification kit.
Figure 12:
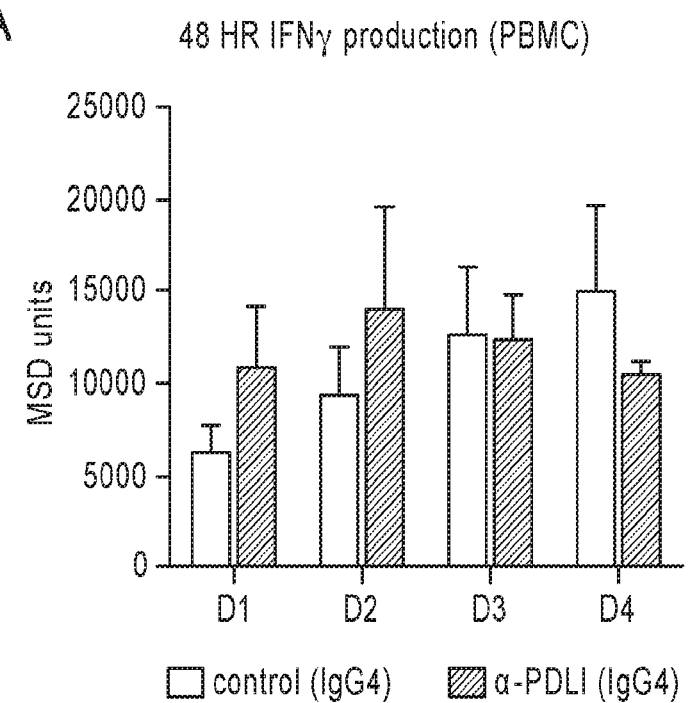
FIG. 12(A) Total PBMCs from 4 donors were stimulated with 50 ng/ml SEB and treated with 10 ug/ml anti-PDL1 (#42) sIgG4 or anti-influenza sIgG4. Restoration of IFNγ production (upper) or TNFa production (lower) was measured. (B) Parental anti-CCR4 antibody, c1567IgG, inhibited chemotaxis of Tregs to CCL22. (C) CD4+CD25− T cells were CFSE-labeled, incubated with Tregs at 10:1 ratio, and then stimulated with anti-CCR4 mAb and control mAb in the presence of anti-CD3/28 co-stimulation. After 3 and 7 days cells were harvested and analyzed by flow cytometry. The percentage of cells was calculated among the fluorescence positive CD4+CD25− T and counting beads. The percent proliferation was normalized to CD4+CD25− T effector cells at Day 0. The data shown were calculated from two independent experiments. Bars represent mean±S.D. (D) IFNγ ELISpot analysis of mAb2-3 and control antibody treated CD4+CD25− Teff cells. Data represents the quantification from three separate experiments using three individual donor bloods. (E) Left, CFSE-labeled Teffs ($5 \times 10^4$) and unlabeled Tregs ($5 \times 10^3$) were co-incubated with 20 μg/ml PHA in 96-well plates for 5 days. The CFSE-labeled Teffs were harvested and CFSE intensity was analyzed by flow cytometry. The proliferation of Teffs were only observed when the coculture incubated with anti-GITR mAb. Right, IFNγ production in the same cultures was further measured by MSD. CFSE-labeled Teffs ($5 \times 10^4$) and unlabeled Tregs ($5 \times 10^3$) were co-incubated with 20 μg/ml PHA in 96-well plates for 5 days. The CFSE-labeled Teffs were harvested and CFSE intensity was analyzed by flow cytometry. Teffs were proliferated after 5-day incubation with PHA, but not in the Teff/Treg coculture. Left, IFNγ production in the same cultures was measured by MSD.
Figure 12:
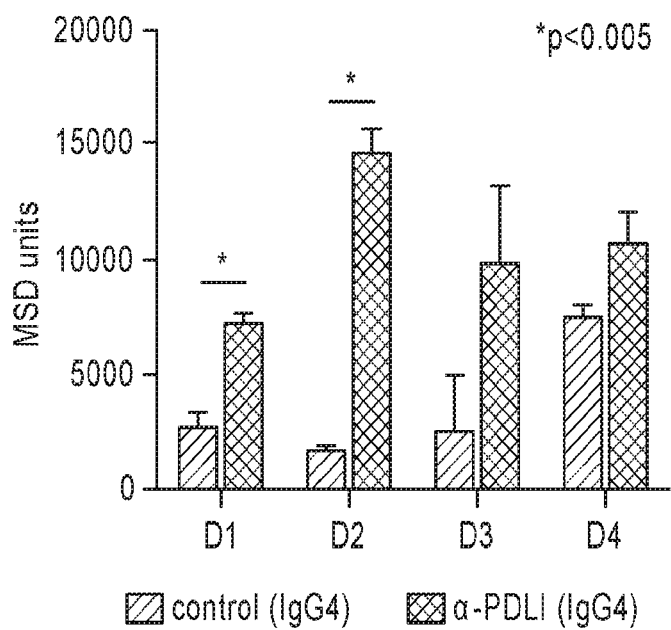
Figure 12:
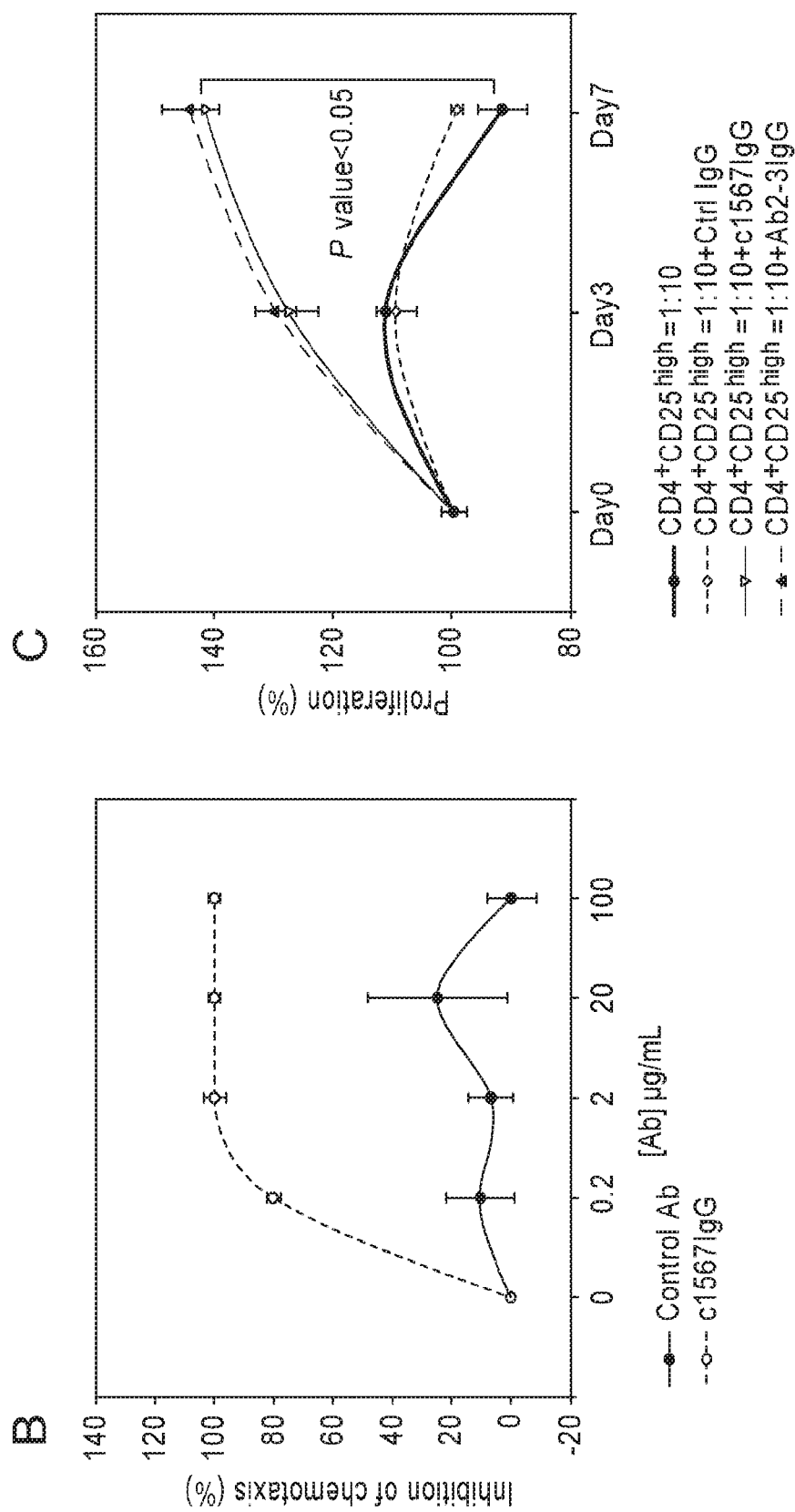
Figure 12:
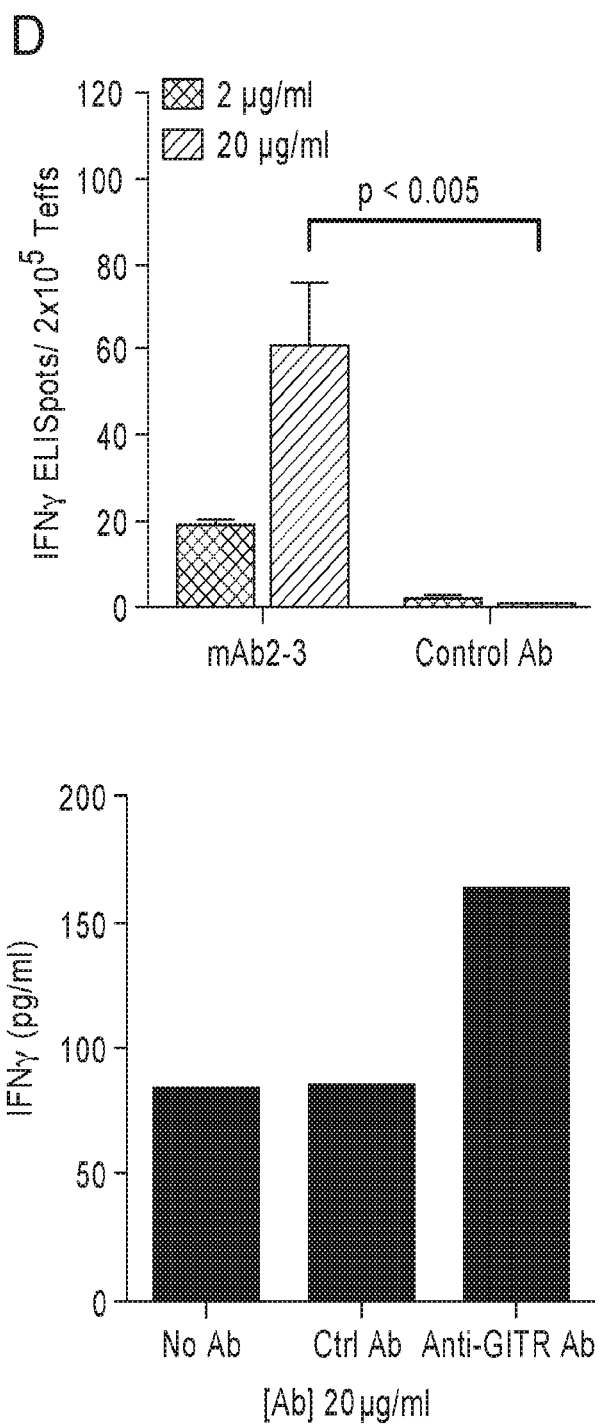
Figure 12:
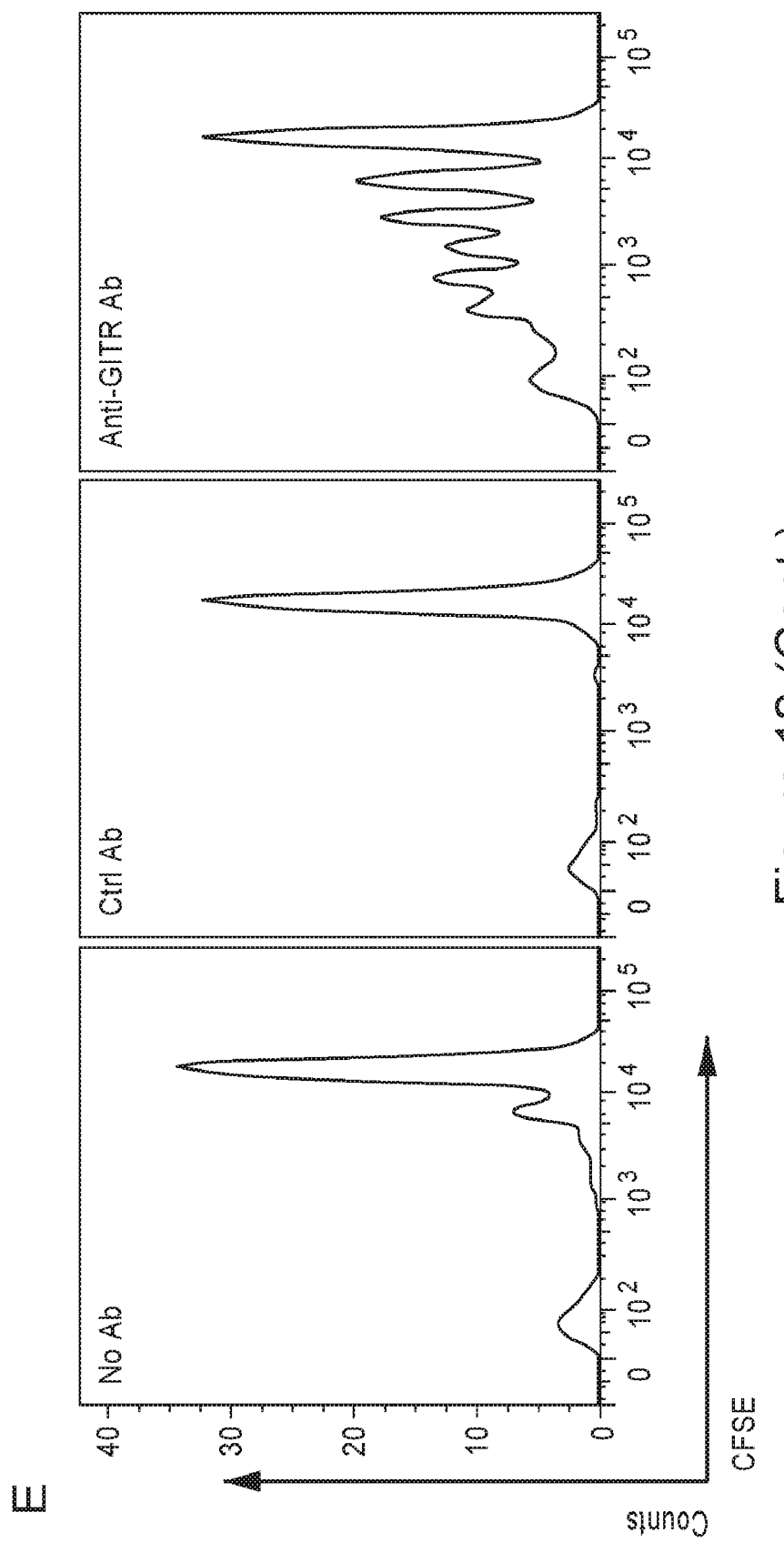
Figure 13:
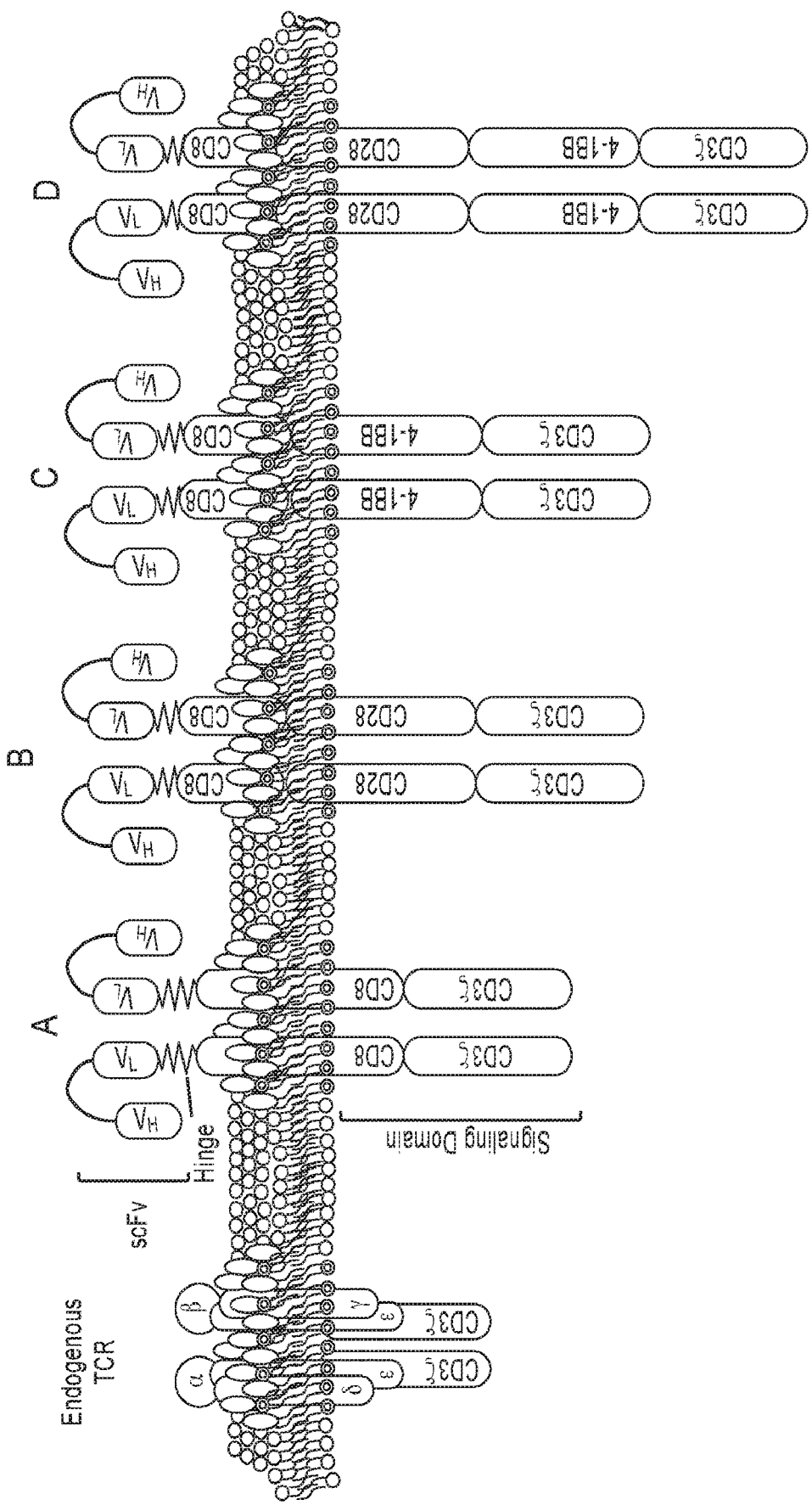
FIG. 13 is an illustration showing different CART configurations according to the invention.
Figure 14:
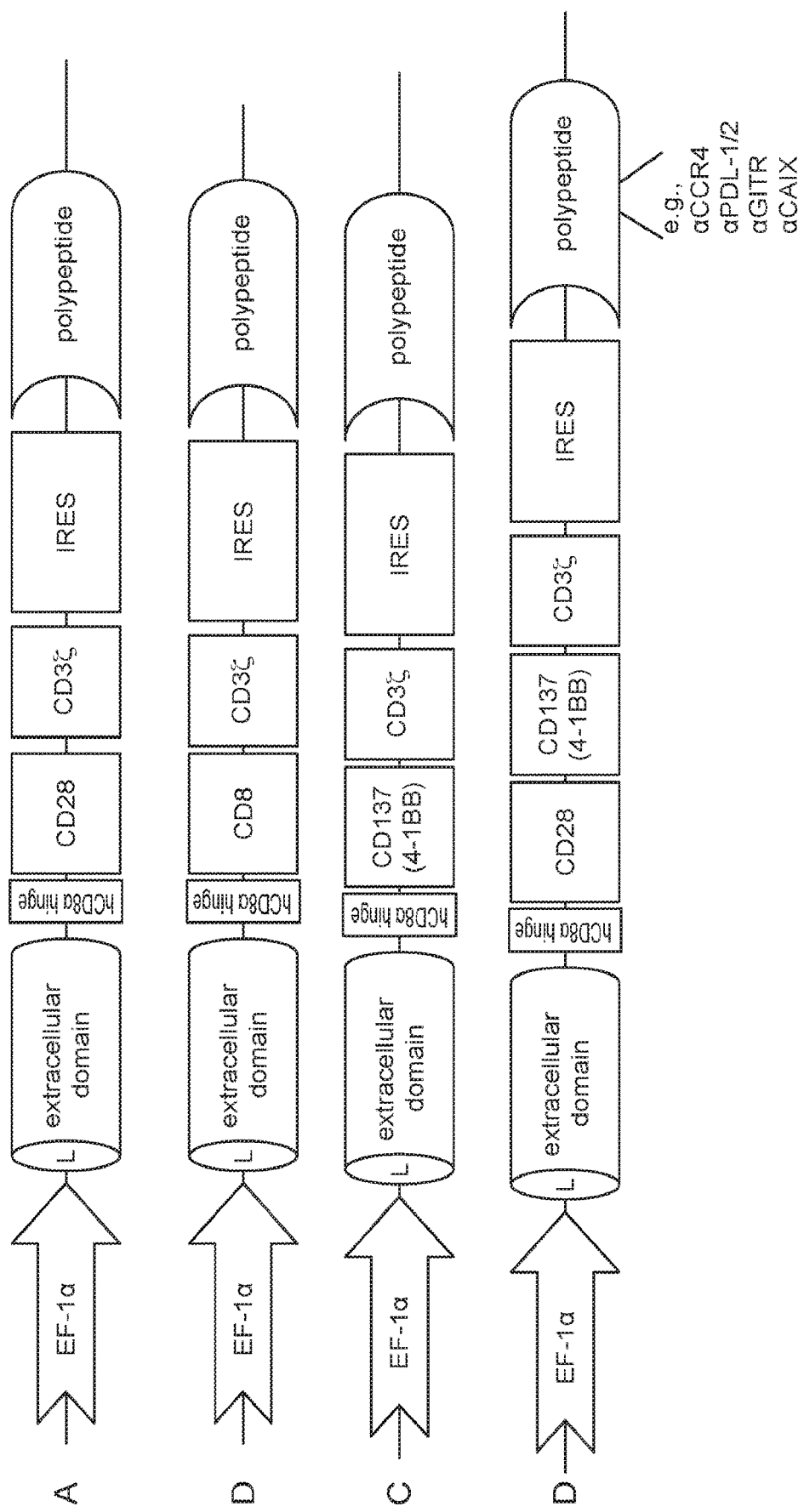
FIG. 14 is an illustration showing different armed CART configurations according to the invention.
Figure 15:
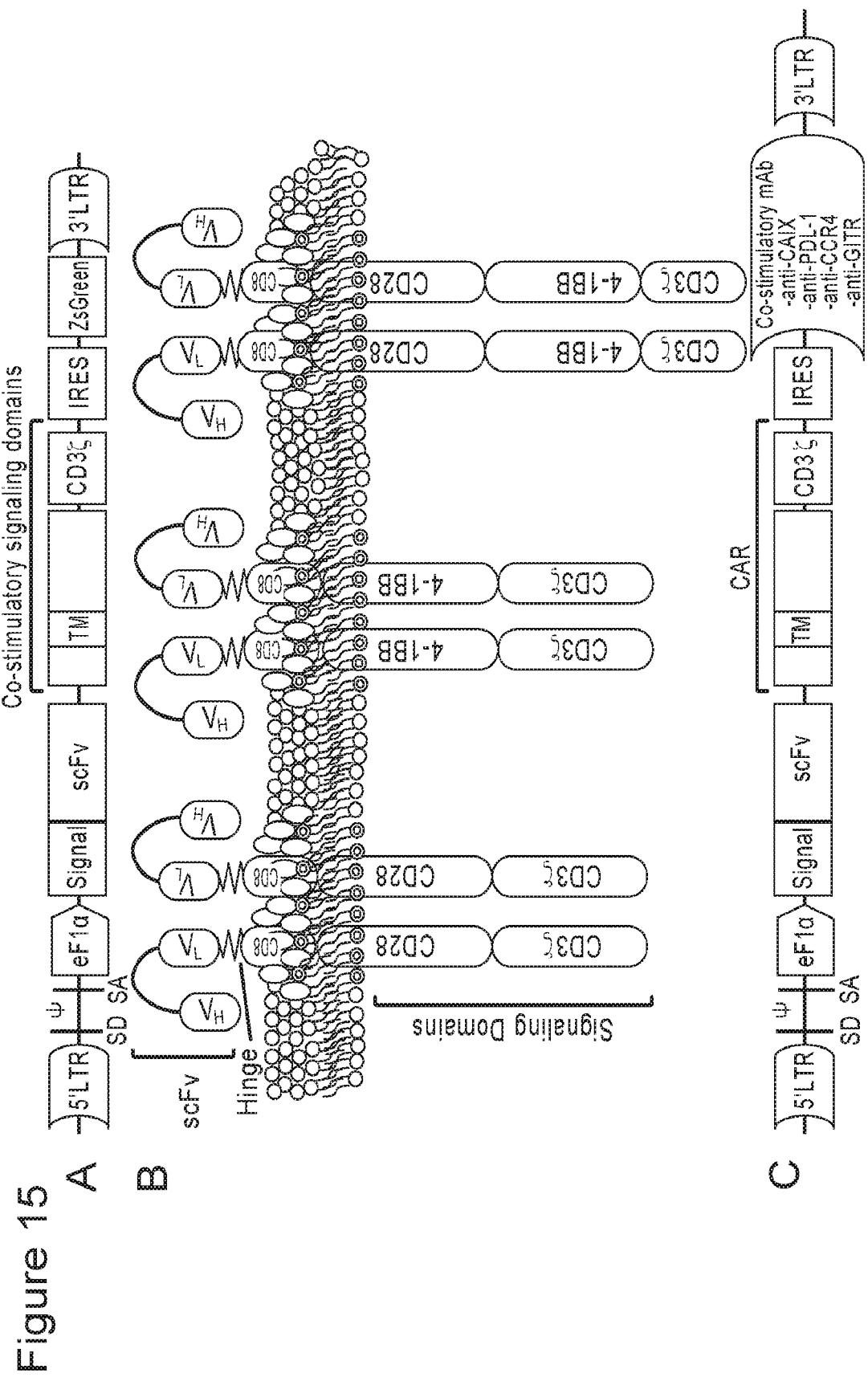
FIG. 15, panels A, B, and C, are further illustrations showing different armed CART configurations according to the invention.
Figure 16:
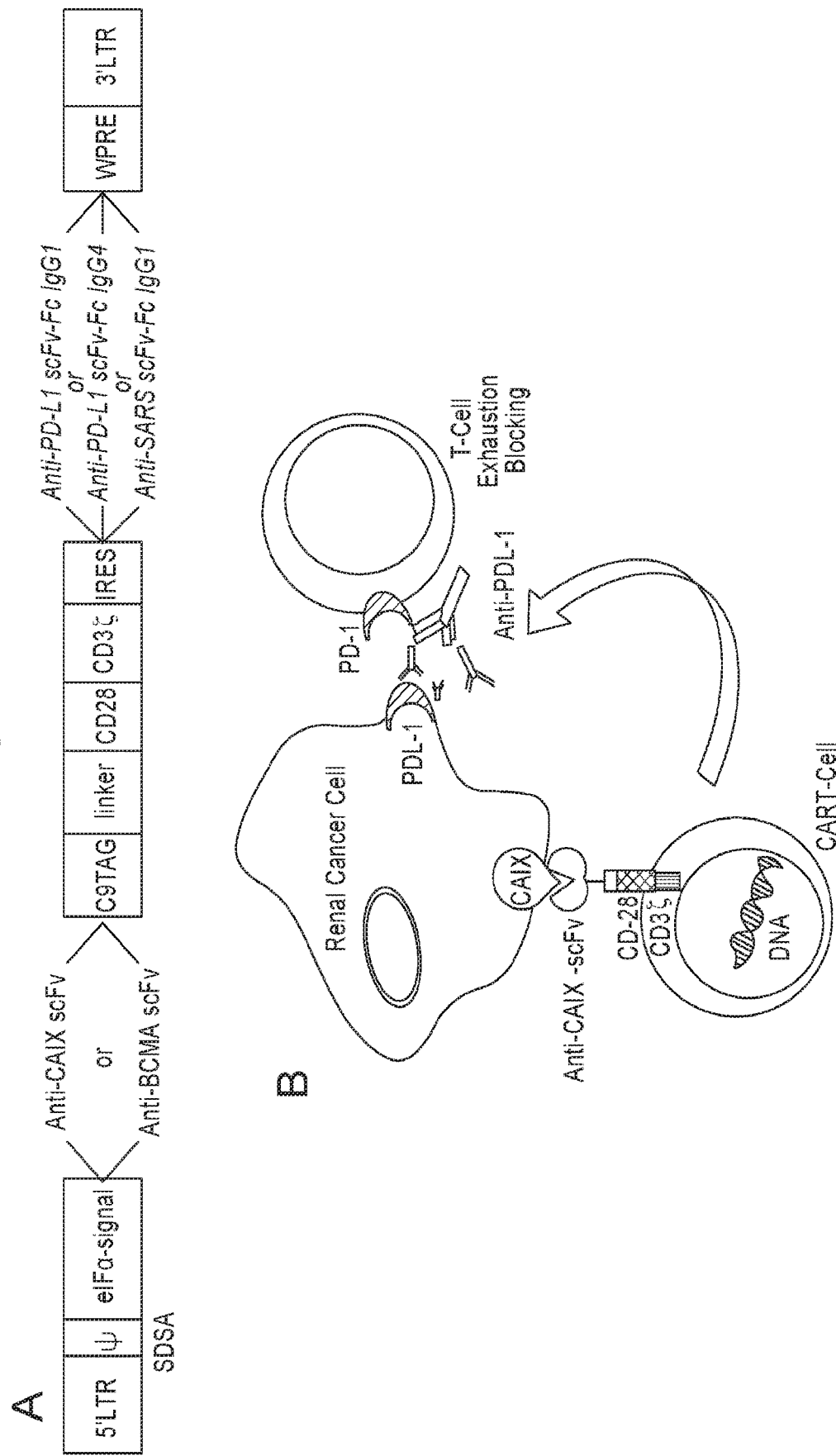
FIG. 16 is a series of illustrations and graphs indicating chimeric antigen receptors (CAR) constructs for CD8+ T cell transduction. (A) Schematic representation of second generation pHAGE lentiviral vectors containing CD28 as a co-stimulatory domain. The anti-carbonic anhydrase IX (CAIX) or the Anti-B-cell maturation antigen (BCMA) scFv (as a negative control) were inserted after the eIFα promoter, in order to express the CAR binding domain. The second cassette, after the Internal Ribosome Entry Site (IRES) sequence, is responsible by coding the soluble Anti-PD-L1 IgG1 or IgG4 isotypes or the Anti-Severe Acute respiratory syndrome (SARS) coronavirus IgG1. To produce the lentiviruses, the pHAGE vectors were transfected together with the packaging plasmids (Gag, Rev, Tat and VSVG) into 293T LentiX cells using Polyethyleneimine. The viruses were harvested two days after transfection, purified and concentrated using LentiX Concentrator (Clontech™), according to the manufacturer instructions. LTR: long terminal repeat, eIFα: eukaryotic initiation factor alpha, scFv: single-chain variable fragment, C9 TAG: C9 peptide TETSQVAPA (SEQ ID NO: 1678), IRES: Internal Ribosome Entry Site, WPRE: Woodchuck Hepatitis Virus Post-transcriptional Regulatory Element. (B) T cells were transduced with the lentiviruses to generate Anti-CAIX CART Cells, which are able to recognize CAIX positive RCC, and also release Anti-PD-L1 IgG1 or IgG4 in the tumor microenvironment to block PD-1/PD-L1-induced T cell exhaustion. (C) Percentage of CART cells 14 days after transduction, representing the stable long-term expression of CAR by the integrated lentiviruses in CD8+ T cells. The CD8+ T cells were selected using Dynabeads™ CD8 Positive isolation Kit (Life Technologies) and activated with Dynabeads™ Human T Cell Activator CD3/CD28 (Life Technologies) in the presence of IL-21 50 U/mL. IL-21 was added to the medium every 2 days. After 14 days, the CART cells were incubated with human CAIX-Fc or BCMA-Fc, followed by incubation with an APC conjugated anti-human Fc IgG and analyzed by FACS. (D) Concentration of IgG secreted to the medium of transduced T cells evaluated by Human IgG ELISA Quantitation Set (Bethyl Laboratories). (E) Concentration of Anti-PD-L1 antibodies in the supernatant of 293T Cells transduced with lentiviruses containing Anti-CAIX or Anti-BCMA CAR and Anti-PD-L1 IgG1, Anti-PD-L1 IgG4 or unspecific Anti-SARS IgG1 sequences. The antibodies in the supernatant were purified with Protein A sepharose beads (GE Healthcare) and biotinylated using the EZ-Link Sulfo-NHS-LC-Biotin (Thermo Scientific™). These antibodies were incubated with 5 μg/mL of human PD-L1 pre-immobilized in the 96 wells MaxiSorp plate (Nunc™). The biotinylated antibodies were detected by incubation with streptavidin-HRP for 1 h and developed with TMB. The absorbance was read at λ=450 nm. *P<0.001 compared to Anti BCMA/Anti SARS IgG1 and Anti-CAIX/Anti-SARS IgG1. **P<0.05 compared to Anti-CAIX/Anti-PD-L1 IgG1. (F and G) Clonal Expansion of CD8+ CART cells. (F) Concentration of CART cells versus days in the presence of skrc-52 CAIX+/PD-L1- cells. *P<0.05 comparing all CARS to Anti-BCMA/Anti-SARS IgG1. (G) Percentage of transduced T cells versus days in the presence of skrc-52 CAIX positive cells. *P<0.05 comparing all CARS to Anti-BCMA/Anti-SARS IgG1. The CD8+ CART cells were previously cultivated for five days after transduction with Anti CAIX CAR able to express anti-PD-L1 IgG1 (AntiCAIX/Anti-PD-L1 IgG1), IgG4 (Anti-CAIX/Anti-PD-L1 IgG4) or a unspecific Anti-SARS Ab (Anti-CAIX/Anti SARS IgG1) or Anti-BCMA CAR (negative control) able to express an unspecific anti-SARS Ab (Anti-BCMA/Anti SARS IgG1) and activated with Dynabeads™ Human T Activator CD3/CD28 (Life Technologies) in the presence of IL-21 50 U/mL. The beads were removed and the CART cells were cultured with skrc52 CAIX+ PD-L1- and IL-21 (50 U/mL), which was added to the medium every 2 days for 21 days. The results represent the average±SD of three donors in duplicate.
Figure 16:
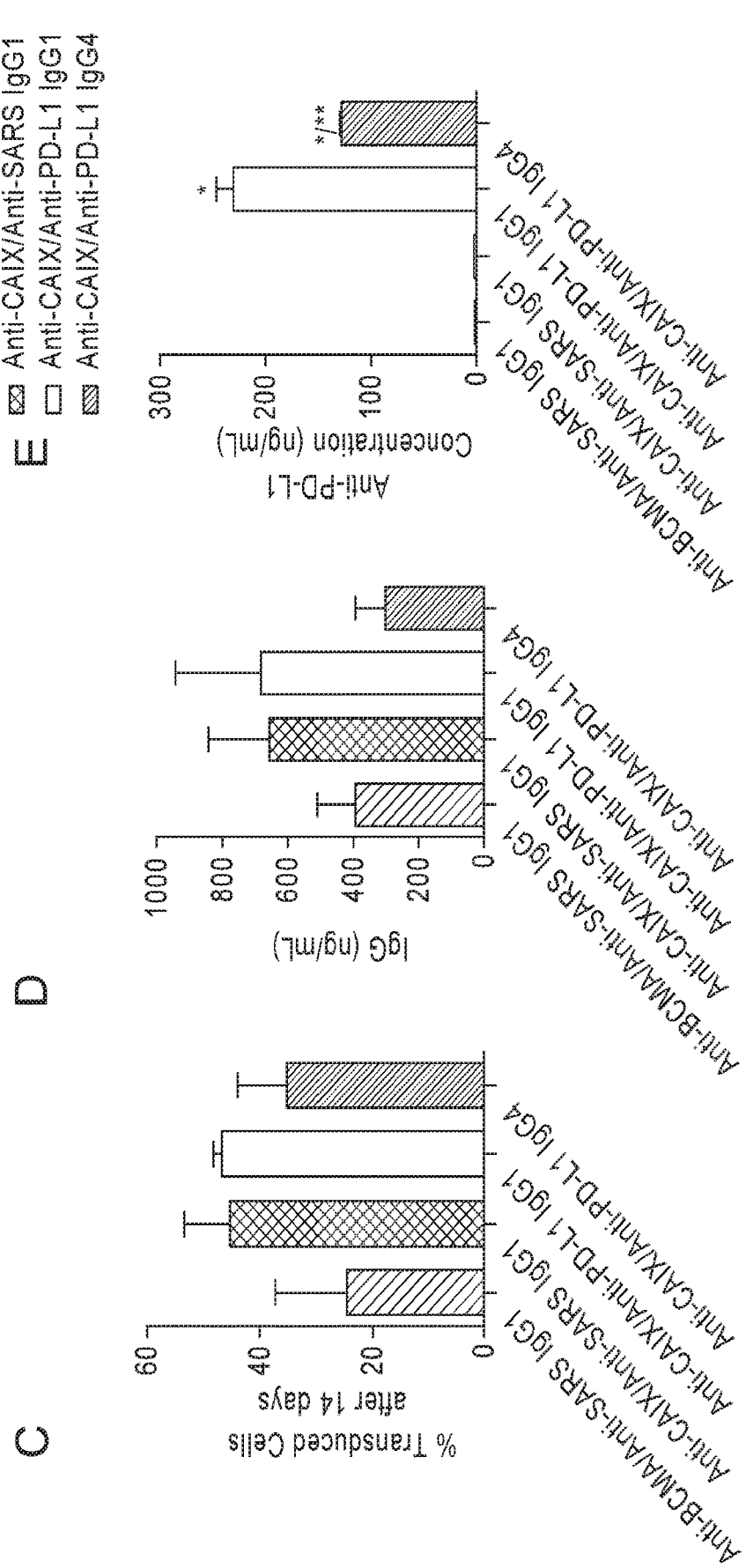
Figure 16:
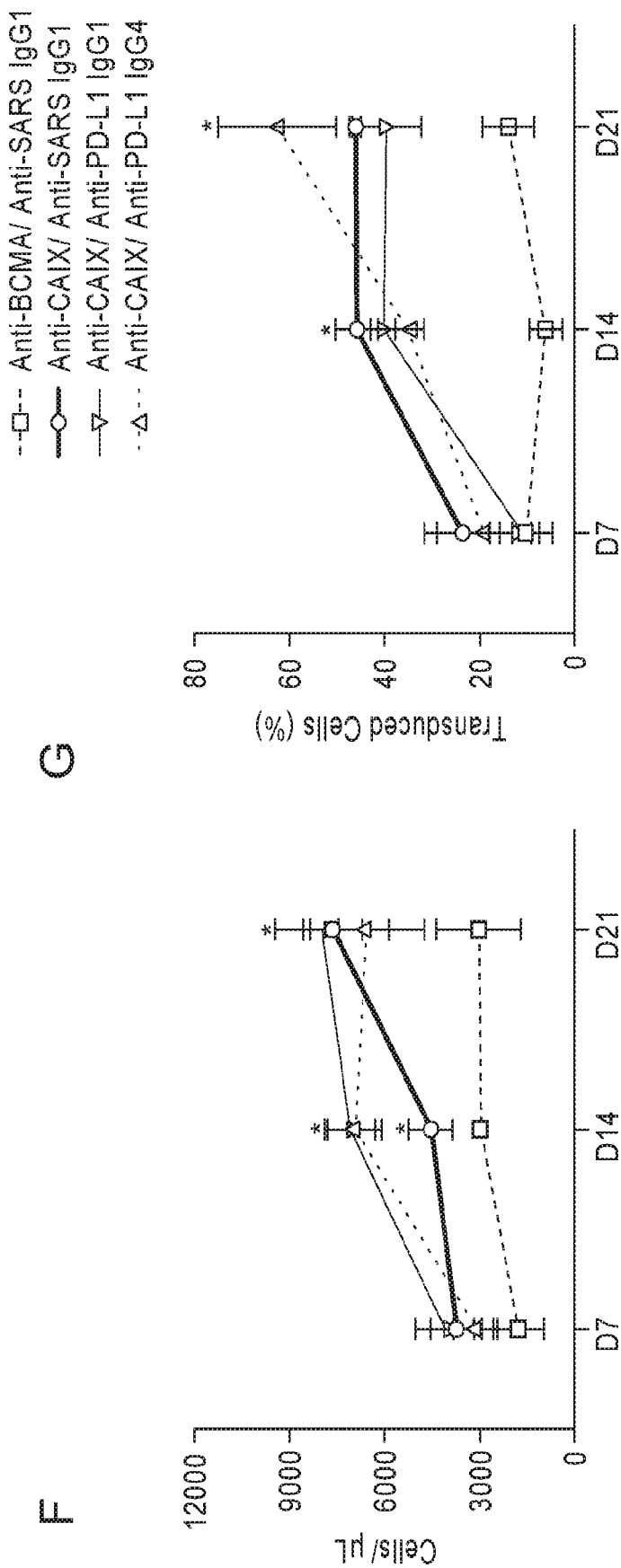
Figure 17:
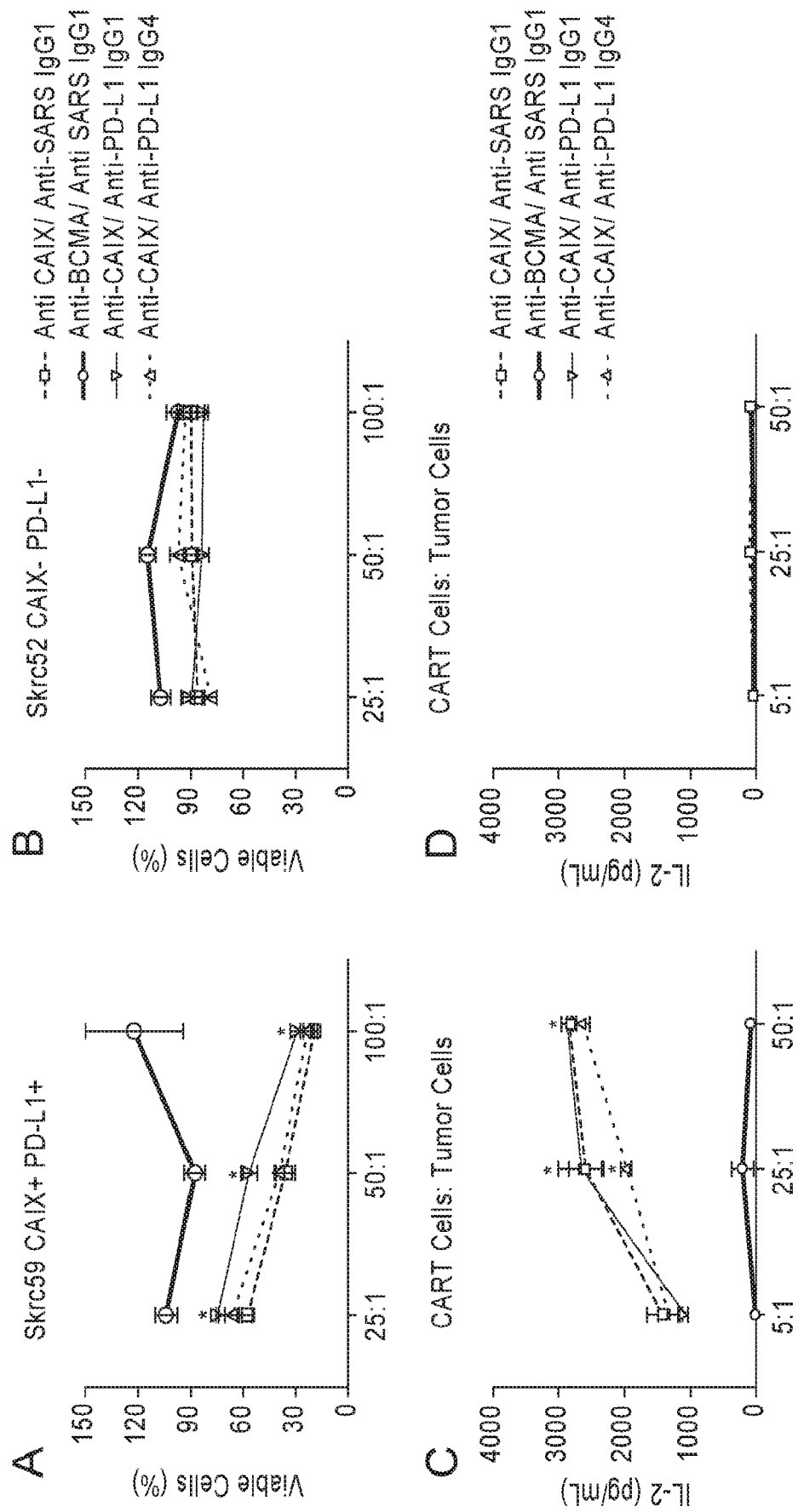
FIG. 17 is a series of graphs that illustrate CART cell effector function. (A) Viability of Skrc59 CAIX+/PD-L1+ cells or (B) Skrc52 CAIX-/PD-L1- cells incubated overnight (O.N.) with CART cells Anti-CAIX/Anti-PD-L1 IgG1, Anti-CAIX/Anti-PD-L1 IgG4, Anti-CAIX/Anti SARS IgG1 or Anti-BCMA/Anti SARS IgG1. These CART cells were used 4 days after lentiviral transduction. The cell viability was evaluated by MTT (Molecular Probes™). *P<0.05 for all CART cells compared to Anti BCMA/Anti SARS IgG1 (C) IL2 released by CART cells after overnight contact with Skrc59 CAIX+/PD-L1+ cells or (D) Skrc52 CAIX-/PD-L1- cells. The IL-2 secretion was evaluated using the Human IL-2 ELISA Ready-SET-Go Kit (eBioscience™). *P<0.001 for all CART cells compared to Anti BCMA/Anti SARS IgG1. (E) IFNγ released by CART cells after overnight contact with Skrc59 CAIX+/PD-L1+ or (F) Skrc52 CAIX-/PD-L1- cells. The IFNγ secretion was evaluated using the Human IFNγ ELISA Ready-SET-Go Kit (eBiosciences™). *P<0.05 for all CART cells compared to Anti-BCMA/Anti-SARS IgG1. (G) Ab-dependent cell-mediated cytotoxicity of skrc59 CAIX+/PD-L1+ or (H) skrc52 CAIX-/PD-L1- after incubation with the supernatant (SN) of CART cells containing 500 ng/mL of the Anti-PD-L1 IgG1, Anti-PD-L1 IgG4 or the Anti-SARS IgG1. To obtain the antibodies, CART cells were incubated for six days with Dynabeads™ Human T Activator CD3/CD28 (Life Technologies) in the presence of IL-21 50 U/mL. After 7 days, the medium containing the mAbs was harvested NK cells were purified using an EasySep™ Human NK Cell Enrichment Kit (StemCell™ Technologies). RCC cell lines Skrc59 CAIX+ PD-L1+ and Skrc52 CAIX- PD-L1- were used as target cells and plated at 1.5×10³/well in a 96-well plate. RCC cells were incubated for 1 hour, 37° C., with 50 μL of the CART cells supernatant adjusted for 500 ng/mL of the respective Ab Anti-PD-L1 IgG1, Anti-PD-L1 IgG4 or Anti-SARS IgG1. After the incubation, the cells were washed with medium and incubated with 12.5:1, 25:1 or 50:1 NK cells for 4 h, 37° C. Culture supernatants were harvested by centrifugation and LDH measured in the supernatant by CytoTox 96® Non-Radioactive Cytotoxicity Assay (Promega™) at 490 nm. These results represent the average±SD of three donors in duplicate.
Figure 17:
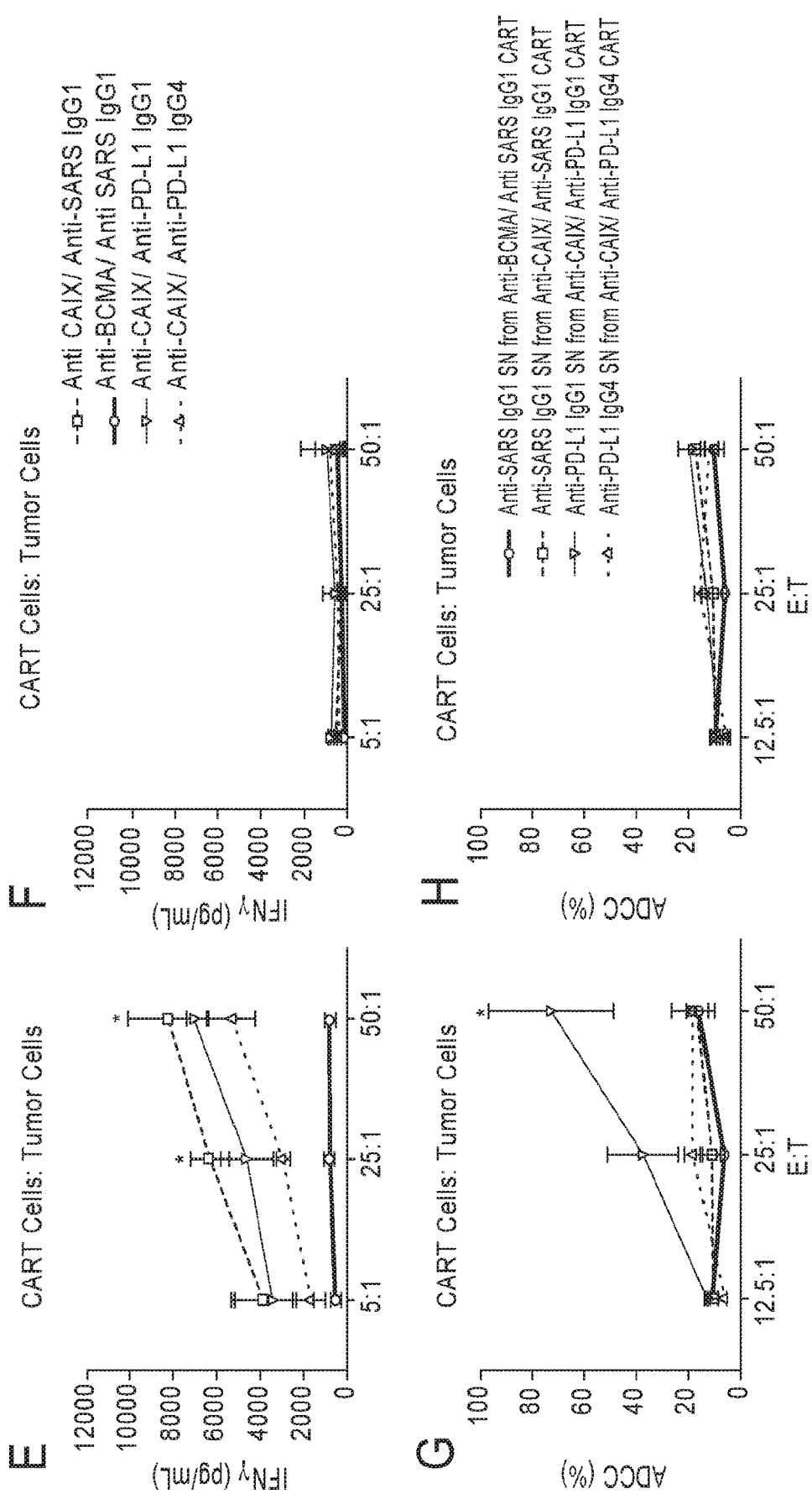
Figure 18:
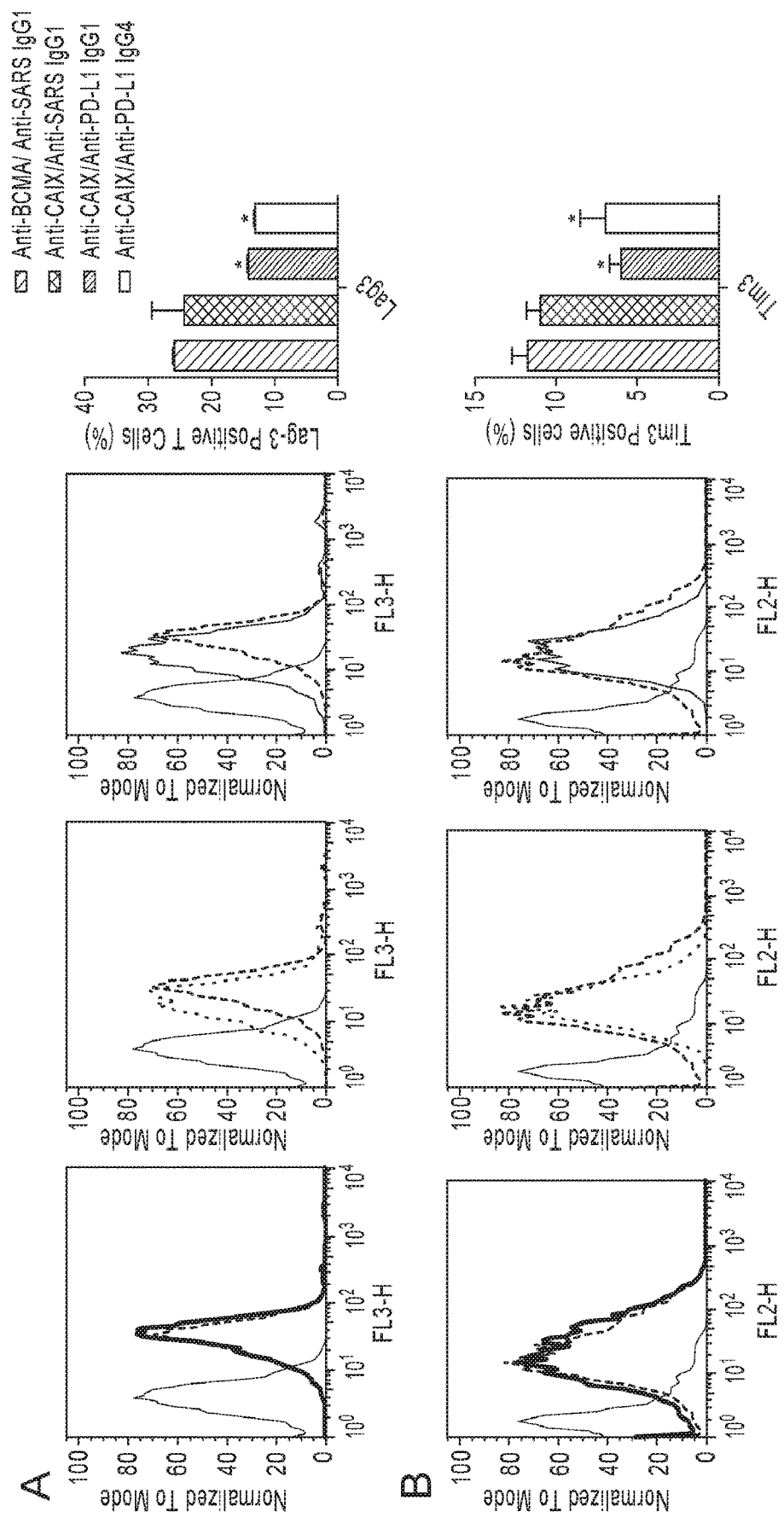
FIG. 18 is a series of graphs that depict CART cells expression of exhaustion markers. (A) Lag3, (B) Tim3 and (C) PD-1 expression. *P<0.05 compared to Anti-CAIX/Anti-SARS IgG1 and Anti-BCMA/Anti-SARS IgG1. The CD8+ CART cells were selected using Dynabeads™ CD8 Positive isolation Kit (Life Technologies), activated with Dynabeads™ Human T Activator CD3/CD28 (Life Technologies) and transduced with the following CARs: Anti-CAIX/Anti-PD-L1 IgG1, Anti-CAIX/Anti-PD-L1 IgG4, Anti-CAIX/Anti SARS IgG1 or Anti-BCMA/Anti SARS IgG1. These cells were cultured in the presence of IL-21 50 U/mL and Dynabeads™ Human T Activator CD3/CD28 for five days. After this period the CART cells were co-cultured with Skrc-59 CAIX+ PD-L1+ for 2 days in order to stimulate exhaustion. CART cells were stained with FITC-conjugated anti-human PD-1, PE-conjugated anti-human Tim3 and PerCP/Cy5.5 anti-human Lag3 and analyzed by FACS. (D) Viability of Skrc59 CAIX positive/PD-L1 positive cells after incubation with exhausted CART cells. The cell viability was evaluated by MTT (Molecular Probes). *P<0.05 compared to both Anti-CAIX/Anti-SARS IgG1 and Anti-BCMA/Anti-SARS IgG1. **P<0.05 compared to Anti-CAIX/Anti-PD-L1 IgG1. These results represent the average±SD of three donors.
Figure 18:
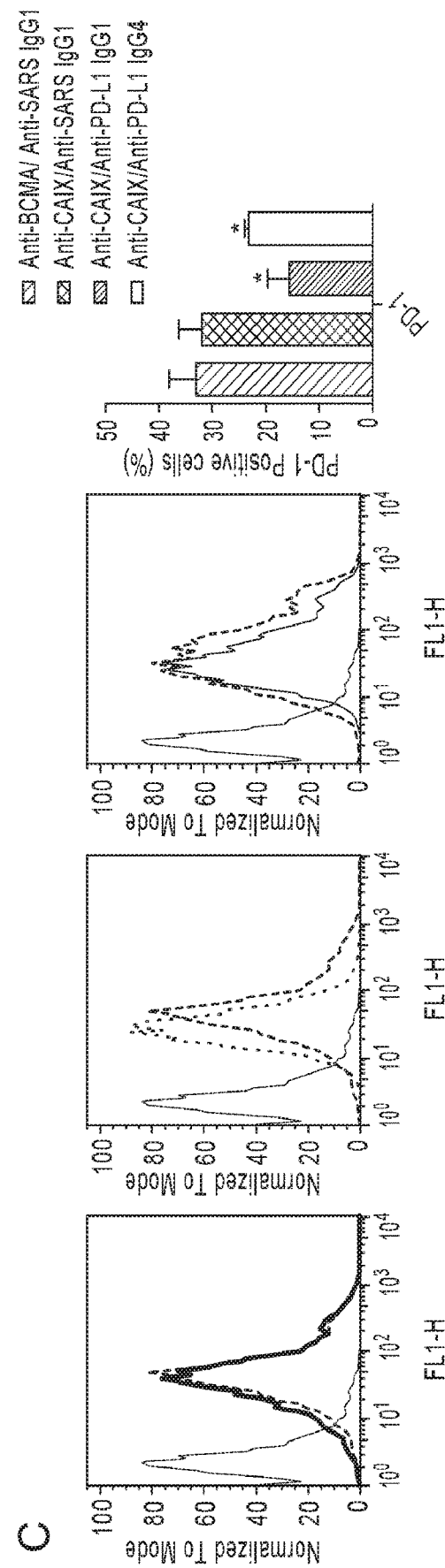
Figure 18:
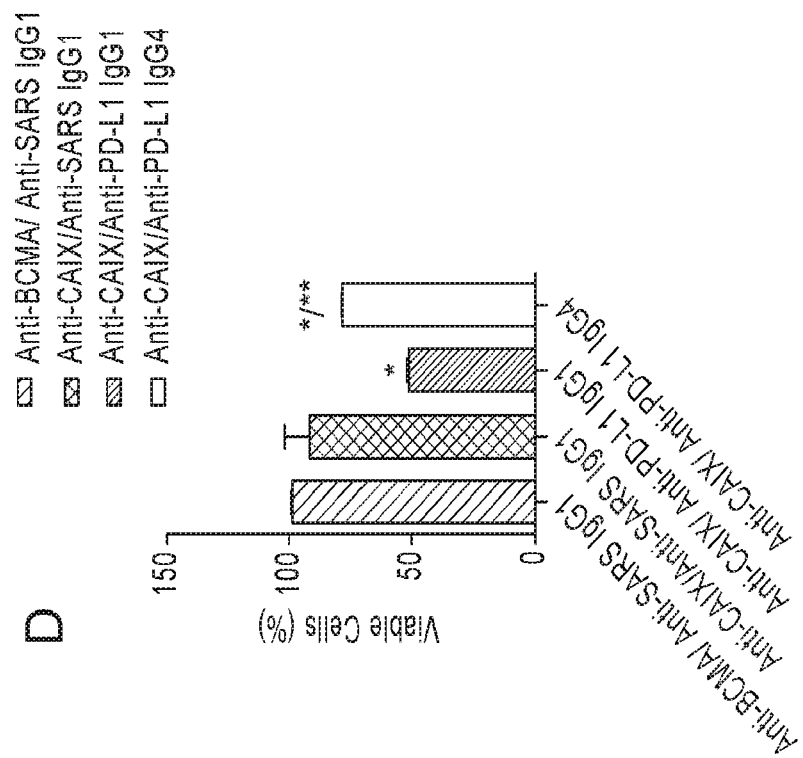
Figure 19:
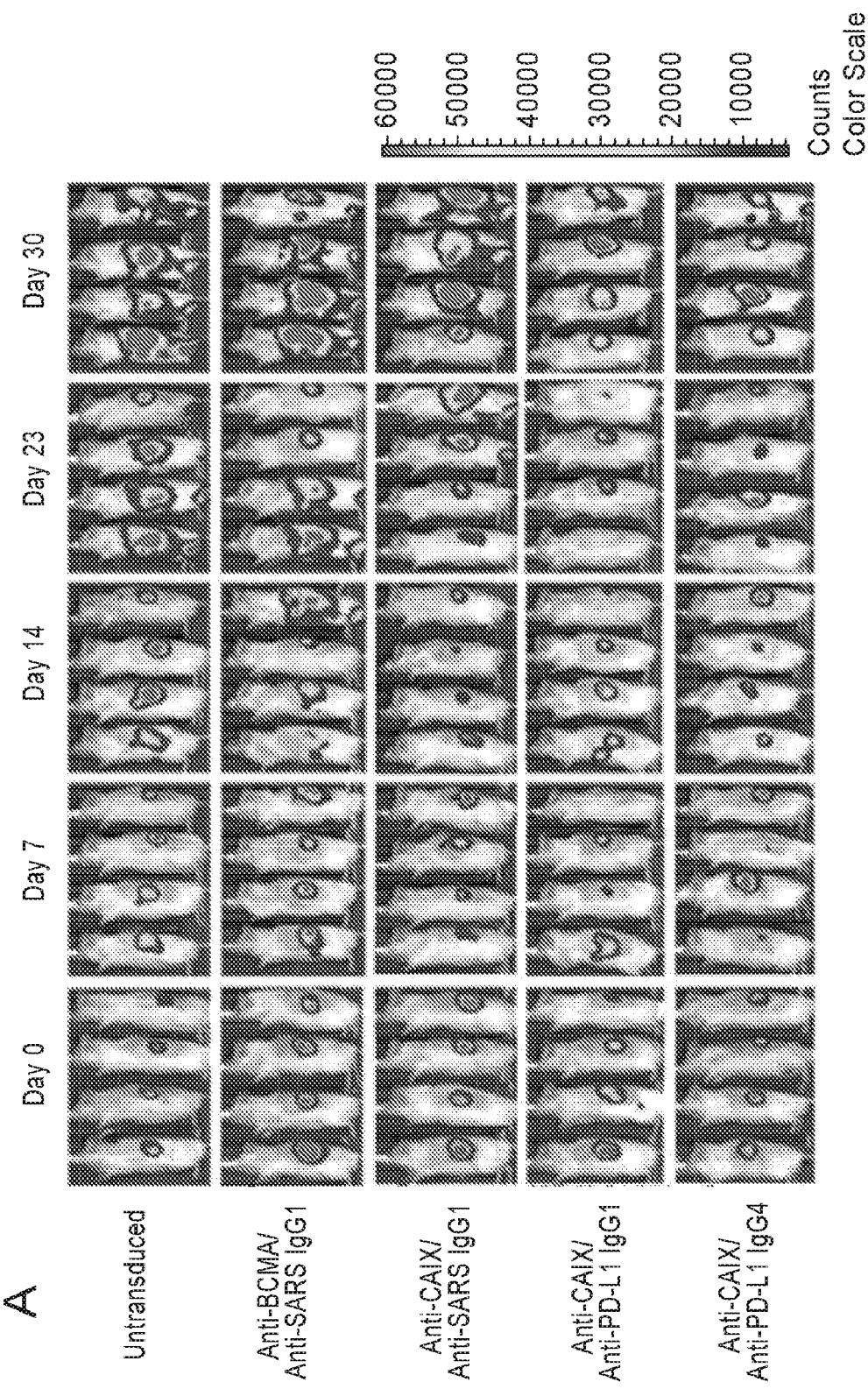
FIG. 19 is a series of images and graphs that depict the effect that CART cells have in an orthotopic model of human RCC. (A) NSG Mice (N=35) were injected with 5.0×104 skrc-59 CAIX positive, PD-L1 positive and luciferase positive RCC cells. After a week, the mice were injected with 1.0×107 CART or untransduced T cells IV (Day 0). The CART cells were previously transduced with the following lentiviral sequences: Anti-BCMA CAR/Anti-SARS IgG1, Anti-CAIX CAR/Anti SARS IgG1, Anti-CAIX CAR/Anti-PD-L1 IgG1 and Anti-CAIX CAR/Anti-PD-L1 IgG4 (N=6 mice per group). The tumor bioluminescence was quantified after 5 minutes of luciferin IP injection using IVIS. A. Imaging of the tumors before CART injection (Day 0), and after 7, 14, 23 and 30 days after first CART cells injection. A second injection of 2.5×106 cells was made on day 17. (B) Imaging of the tumors after excision at day 30. Scale bar=1 cm. (C) Tumor growth curve. *P<0.05 when Anti-PD-L1 IgG1 and IgG4 groups were compared to Anti-BCMA/Anti-SARS IgG1 and **P<0.05 when Anti-PD-L1 IgG1 and IgG4 groups were compared to Anti-CAIX/Anti-SARS IgG1. (D) Tumor weight after 30 days of treatment. *P<0.05 compared with Anti-BCMA/Anti SARS IgG1 CAR, **P<0.05 compared with Anti-CAIX/Anti-SARS IgG1.
Figure 19:
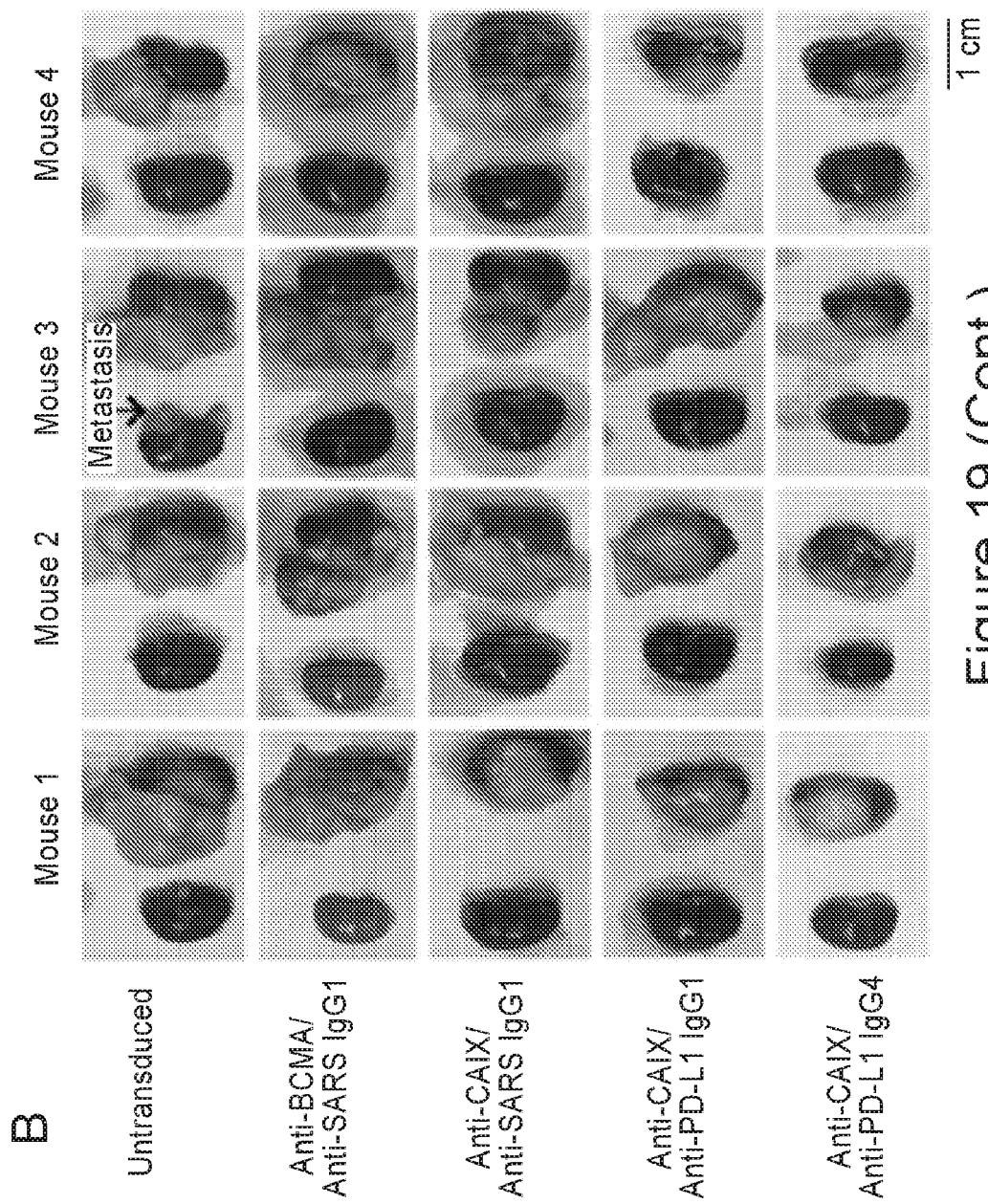
Figure 19:
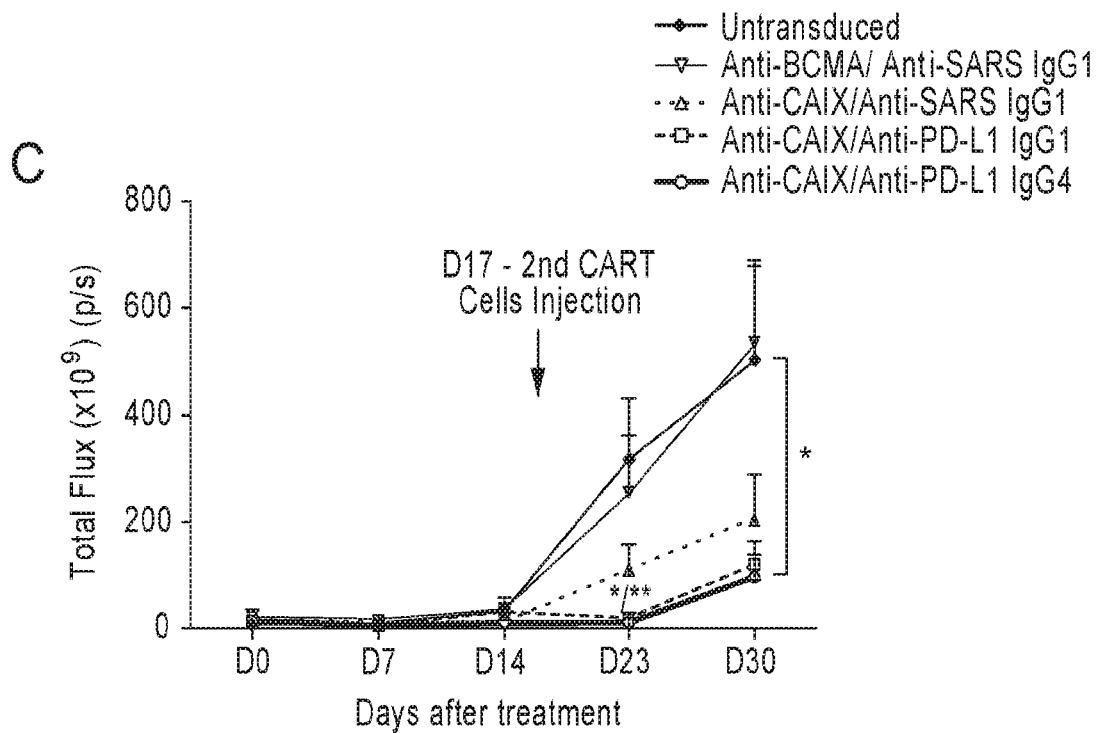
Figure 19:
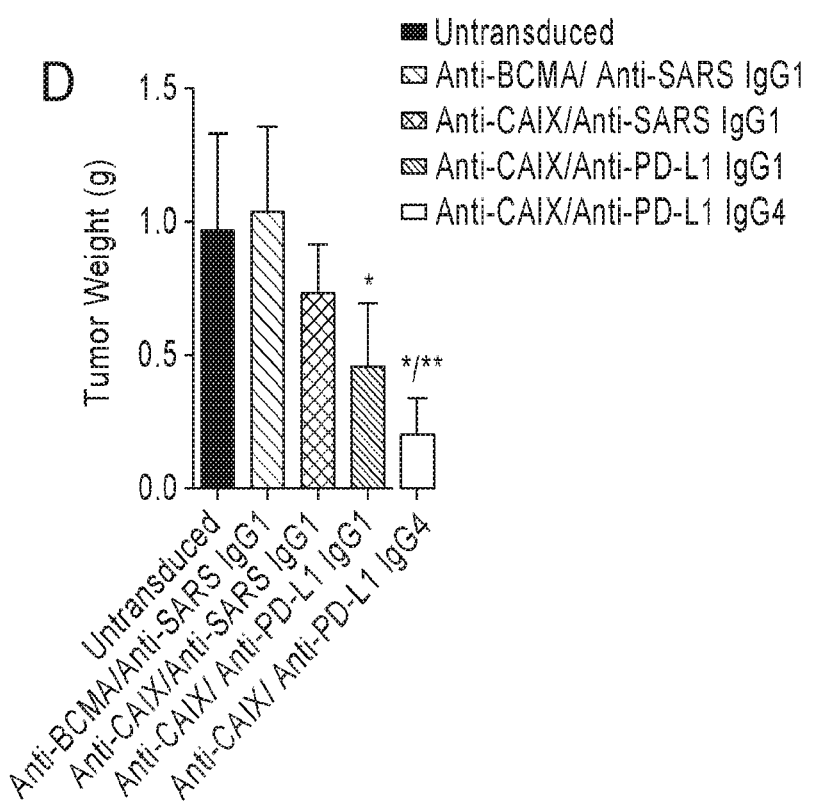
Figure 20:
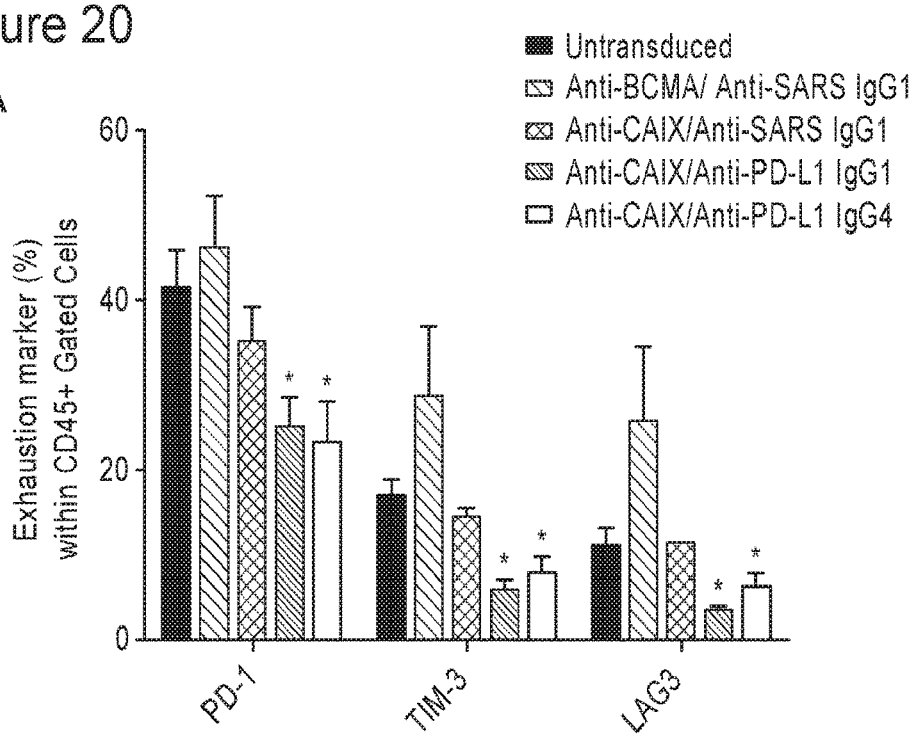
FIG. 20 is a series of graphs and histological images that depict antitumor activity from CART cells. (A) Expression of exhaustion markers in tumor infiltrating lymphocytes (TIL). The kidney tumors from all mice were divided in two parts and one of them was fragmented in small pieces and digested with collagenase and DNAse to extraction of TIL. The CART cells were analyzed for the exhaustion markers PD-1, Tim-3 and Lag3. *P<0.05 compared with untransduced, Anti-BCMA/Anti SARS IgG1 CAR and Anti-CAIX/Anti-SARS IgG1. (B) Detection of Ki67 as a tumor cell proliferation marker and granzyme B to analyze CART cells activity in the tissue. Four-micrometer sections of formalin-fixed, paraffin-embedded tissues were dewaxed and rehydrated in a decreasing ethanol series. Endogenous peroxidase activity was quenched using 3% hydrogen peroxide. The antigen retrieval was performed using pressure cooker in citrate buffer (pH=6.0) for 45 seconds at 123° C., 15 PSI. The tissue sections were incubated for 45 minutes with the rabbit anti human Ki67 polyclonal Ab 1:2000 (Vector, VP-K451), mouse anti-human PD-L1 mAb 10.4 μg/mL (Clone 405.9A11) developed by Dr. Gordon Freeman (Boston, MA), biotinylated CAIX-Fc protein 17 μg/mL (produced in our lab), rabbit anti human granzyme B polyclonal Ab (Abcam, ab4059) 1:100 or rabbit anti-human NCAM (CD56) mAb 1:100 (Abcam, ab133345), followed by secondary HRP conjugated anti-rabbit Ab or HRP-Avidin. The slides were developed using 3,3'-diaminobenzidine (DAB) and counterstained with hematoxylin. The images were obtained in an Olympus BX51 microscopy using a DP71 digital camera (Olympus) and analyzed in the DP Controller Software (Olympus™). The scale bars represent the magnification of the images of each column [500 μm (40×), 100 μm (200×) or 50 μm (400×)]. (C) A series of graphs present percentage quantification of TIL staining positive for Granzyme B, PD-L1-IHC, and Ki67. Also presented in (C) is a Ki67-DAB Pixel count of TILs.
Figure 20:
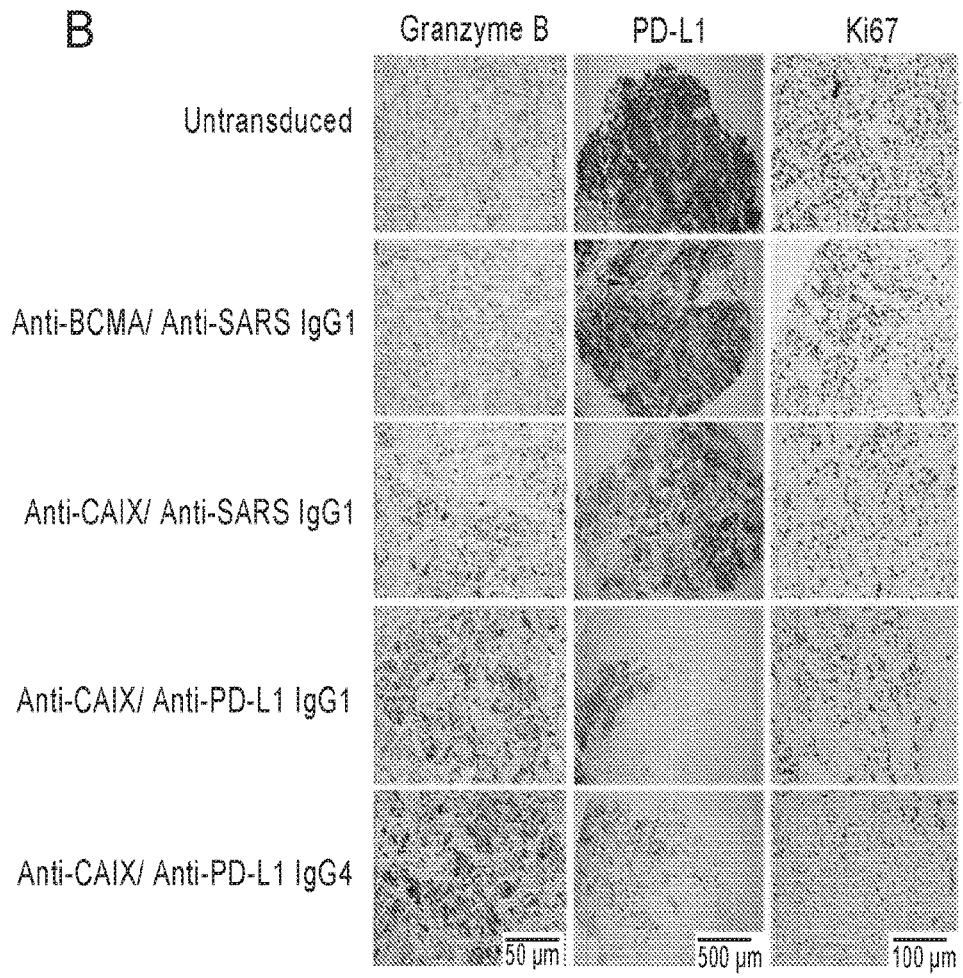
Figure 20:
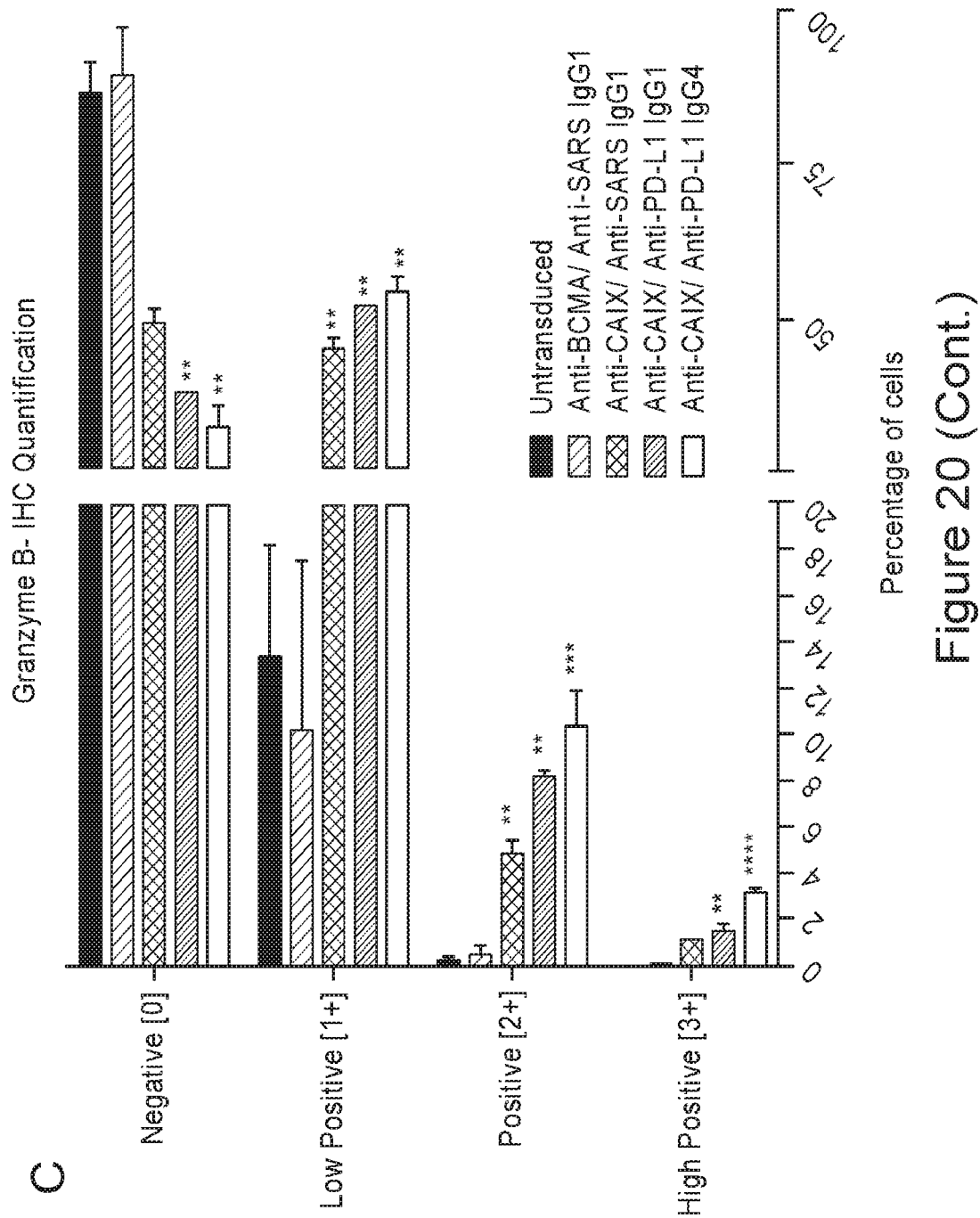
Figure 20:
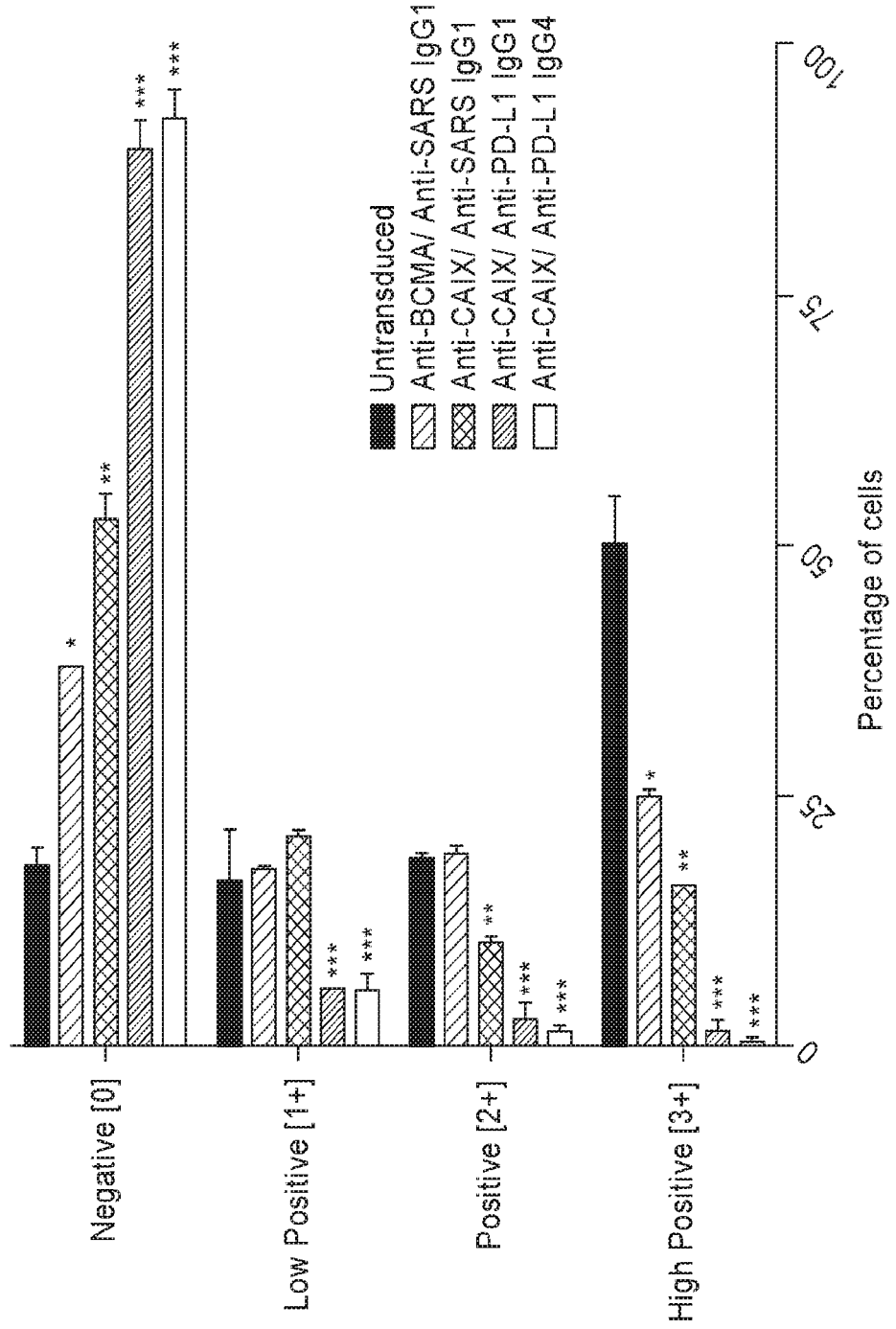
Figure 20:
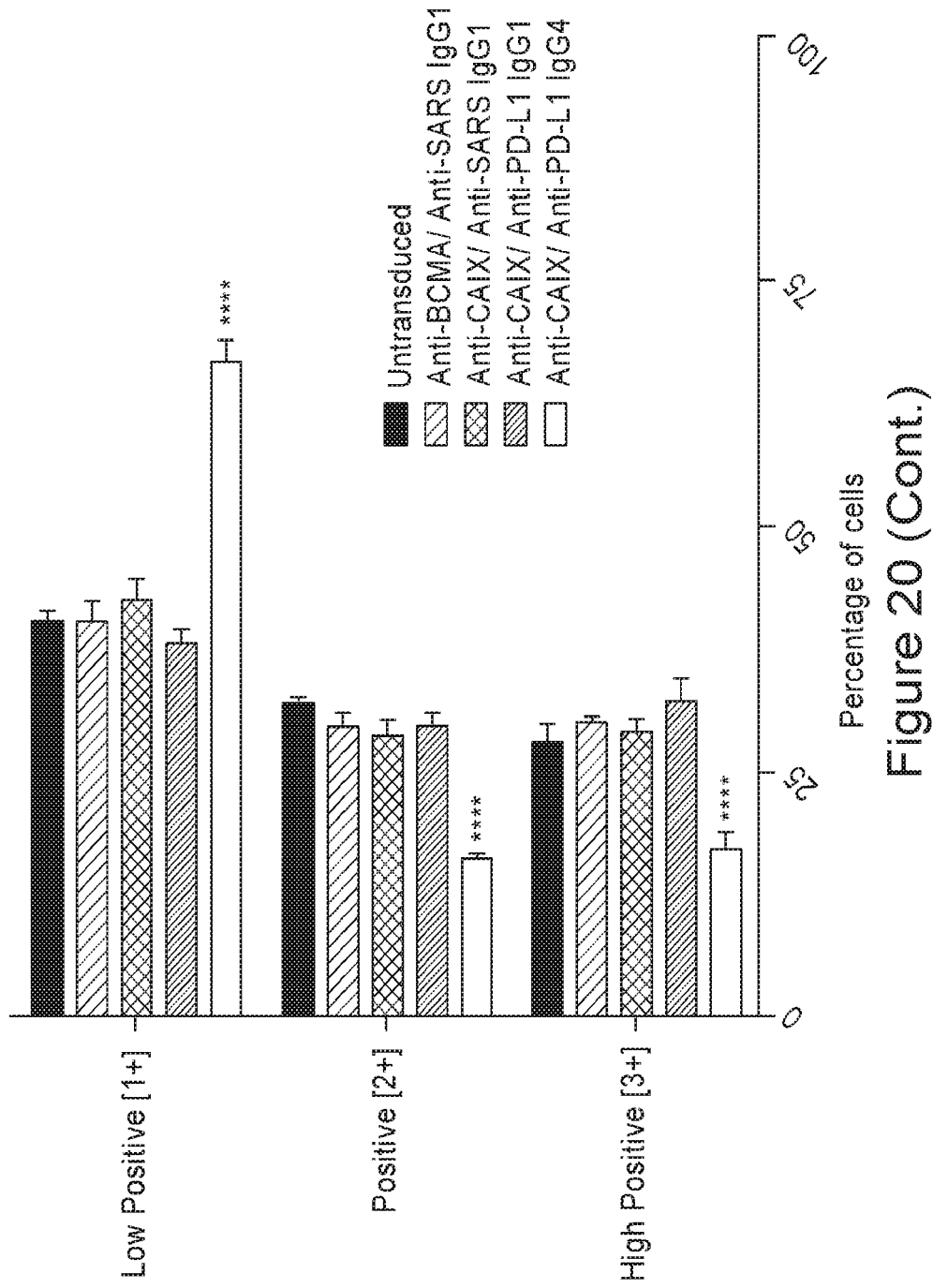
Figure 20:
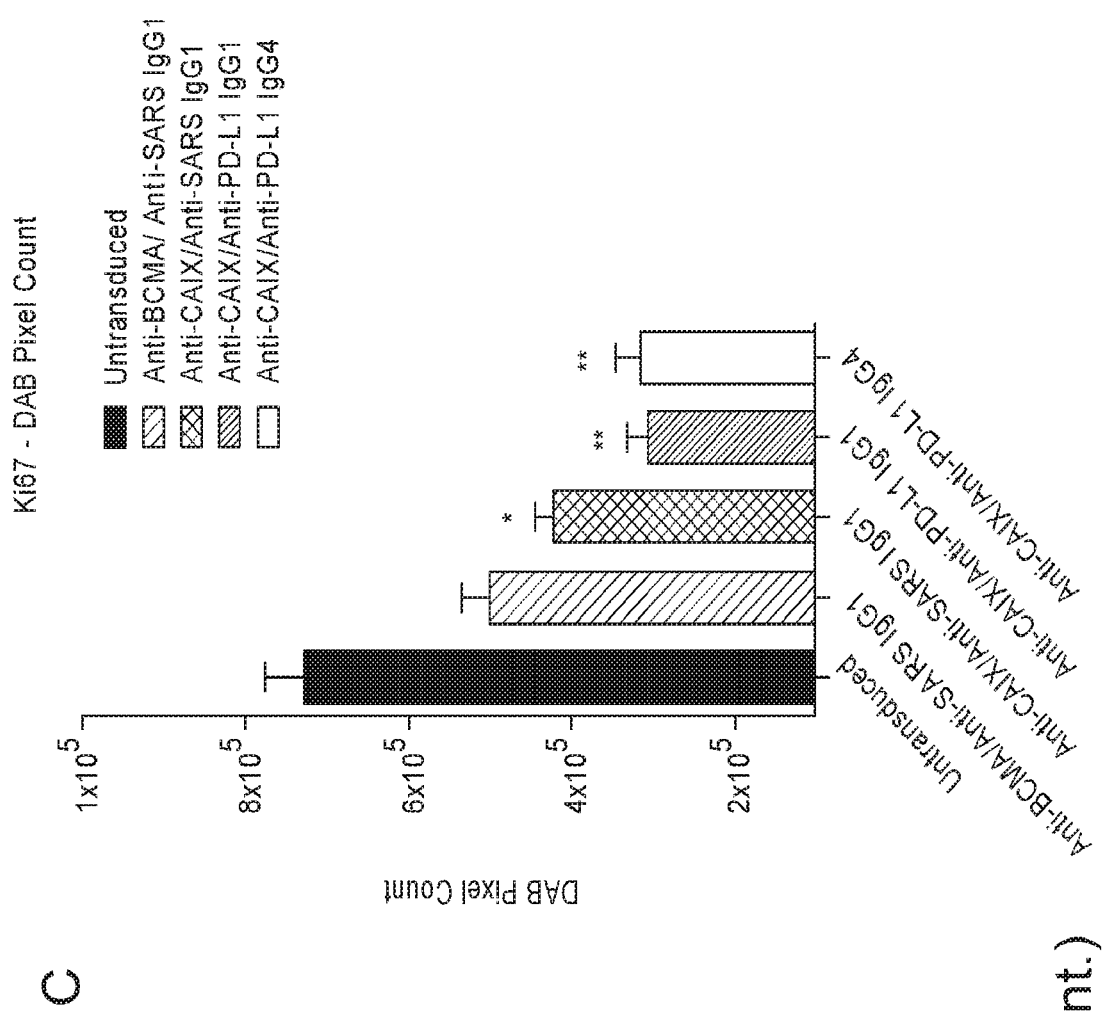
Figure 21:
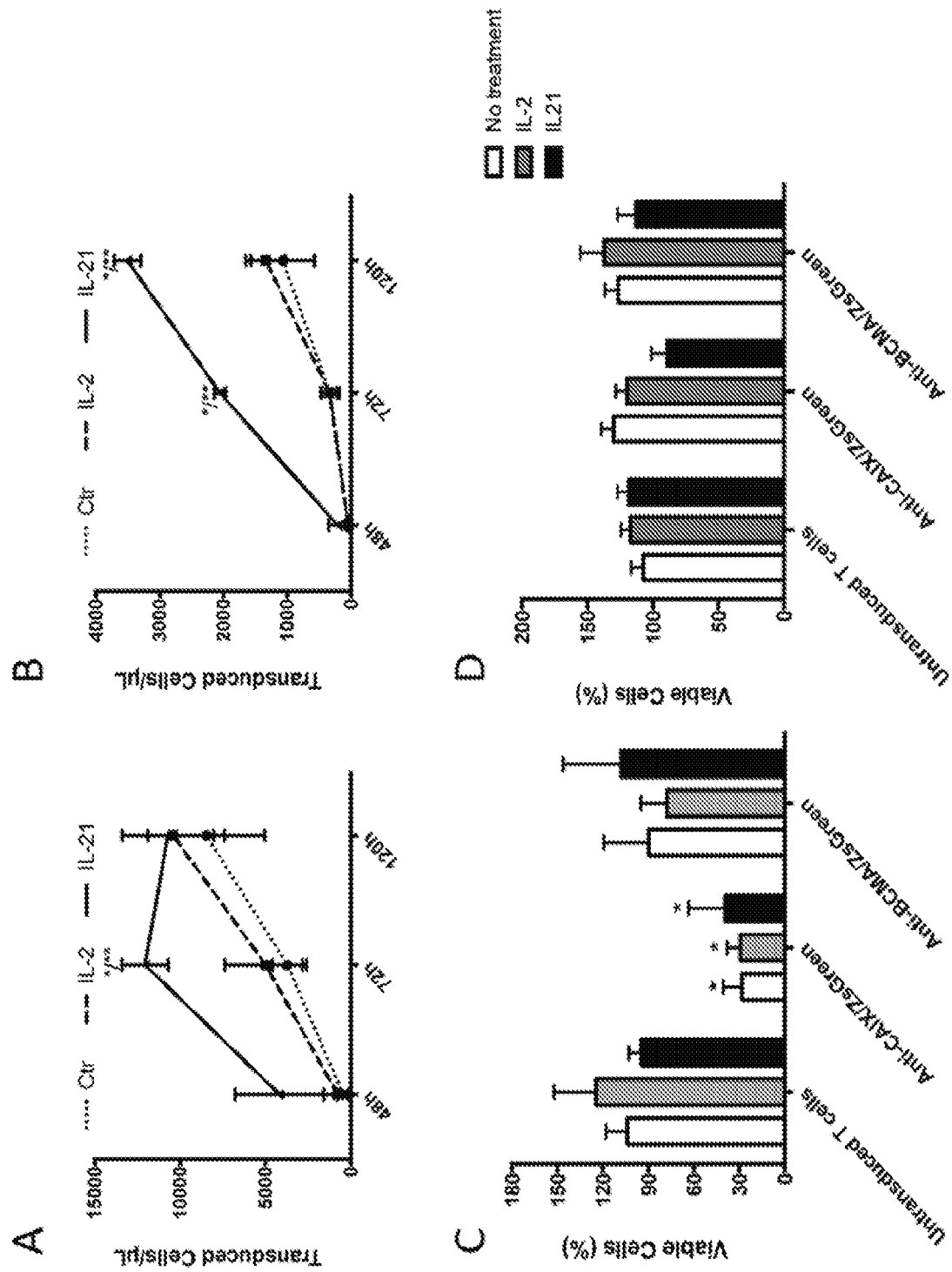
FIG. 21 is a series of graphs that depict the evaluation of IL-2 versus IL-21 to CD8+ CART cells proliferation. A and B. Proliferation of CART transduced cells in the presence of IL-2 or IL-21 evaluated 48 h, 72 h and 120 h after transduction with lentiviruses. (A) Anti-CAIX CART cells or (B) Unspecific Anti-BCMA CART cells (both with ZsGreen in the second cassette). The CD8+ T cells were selected using Dynabeads™ CD8 Positive isolation Kit (Life Technologies) and activated with Dynabeads™ Human T Activator CD3/CD28 (Life Technologies) in the presence of IL2 or IL-21 50 U/mL (Peprotech™). The CART cells transduction was evaluated by ZsGreen expression using FACS. The data represents the average±SD of two donors. *p<0.05 comparing IL-21 with non treated control (Ctr); **p<0.05 comparing IL21 with IL-2. C and D. Viability of RCC cells treated with CD8+ CART cells cultivated in the presence of IL-2 or IL-21. The viability was evaluated by MTT after an overnight incubation of CART cells Anti-BCMA, Anti-CAIX or Untransduced T cells with (C) Skrc-59 CAIX+/PD-L1+ and (F) Skrc-52 CAIX−/PD-L1-RCC cells. The CART cells were previously cultivated in the presence of IL2 or IL-21 50 U/mL for 120 hours. These results represent the average±SD of two donors in triplicate. *P<0.05 comparing Anti-CAIX CAR with Anti-BCMA CAR or untransduced T cells.
Figure 22:
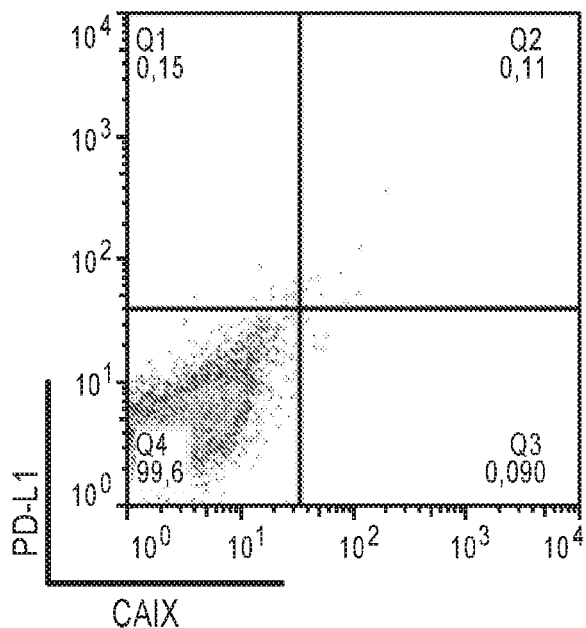
FIG. 22 is a series of flow cytometry graphs that depict the expression of PD-1 and CAIX in the renal cell carcinoma (RCC) lines. (A) Negative control, (B) Skrc52 CAIX−PD-L1−, (C) Skrc52 CAIX+ PD-L1−, (D) Skrc59 CAIX+ PD-L1+. The cells were stained with Anti-human CAIX antibody developed with APC-Anti-human Fc IgG and Biotinylated Anti human PD-L1 antibody developed with PE-Avidin. The analysis was performed by FACS.
Figure 22:
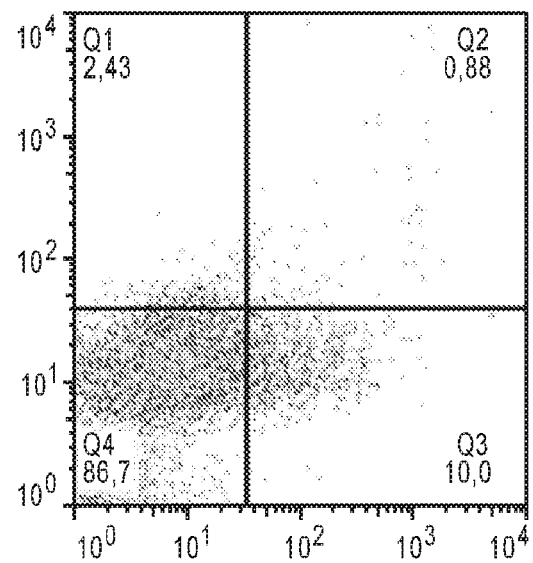
Figure 22:
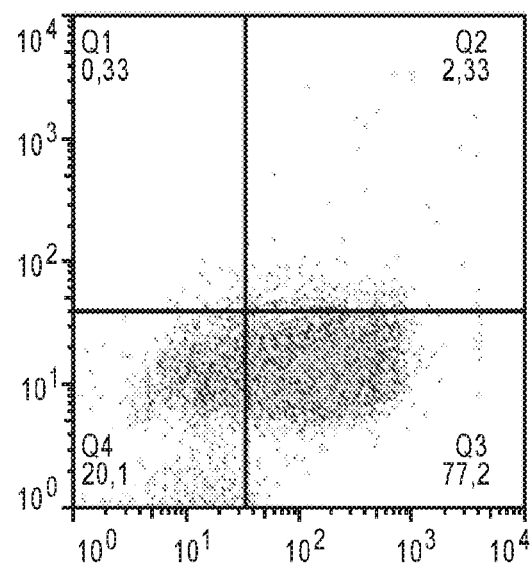
Figure 22:
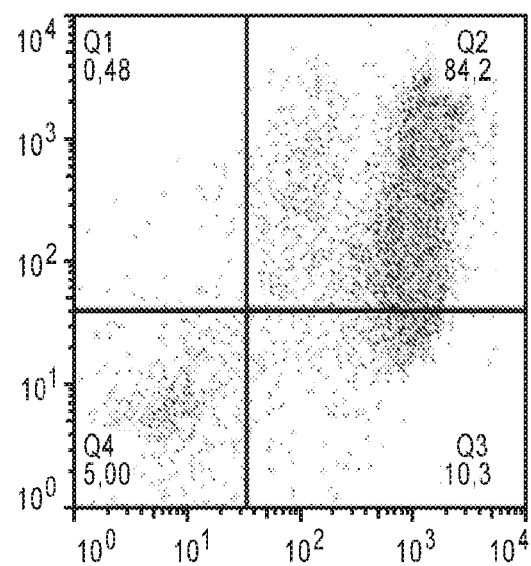

Due to the limitation of fluorescent signal, ZsGreen expressing CART cells could not be observed from the whole tissue section. Therefore on day 3 after G36-CD28z CART cell or LAK treatment, the tumors were harvested and sections were also stained with granzyme B antibody to locate the activated T cells. In FIG. 6C, the dark brown areas of staining show granzyme B+ T cells that are seen infiltrating into the CAIX+ sk-rc-52 tumor sections (FIG. 6C upper left). These granzyme B+ T cells were seen surrounding the tumor (FIG. 6C upper left (a) and middle) and inside the tumor (FIG. 6C upper left (b) and lower). Tumors with necrotic areas were shown in H&E stained slides (labeled as n inside FIG. 6C right middle and lower) and lie at locations near to the granzyme B+ T cells. In contrast, the CAIX+ sk-rc-52 tumors treated with control activated T cells (LAK) (FIG. 7) did not show any granzyme B+ T cells. Similarly, CAIX− sk-rc-59 treated with G36-CD28z CART cells (FIG. 8) or treated with LAK (FIG. 9) showed a low background staining while tumor was proliferating. For positive control of granzyme B staining, CART cells was locally injected into the established sk-rc-52 tumor in mice. After one day, the mice was sacrificed and tumor tissue was sectioned for this staining (FIG. 10).

TABLE 1

Cytokine Secretion After One or Two Weeks of Contact with Tumor Cells*

| CART cells | IFN-γ (pg/ml) | | IL-2 (pg/ml) | |
|---|---|---|---|---|
| | One week | Two weeks | One week | Two weeks |
| RC-SK-52 (CAIX+) Cells | | | | |
| G36-CD28z | 25,788 | 28,192 | 7,524 | 24,937 |
| G36-CD8z | 13,096 | 10,961 | 1,470 | 10,029 |
| A8-CD28z | 55 | 55 | 9 | 13 |
| LAK | 68 | 58 | 9 | 13 |

TABLE 1-continued

Cytokine Secretion After One or Two Weeks of Contact with Tumor Cells*

| CART cells | IFN-γ (pg/ml) | | IL-2 (pg/ml) | |
|---|---|---|---|---|
| | One week | Two weeks | One week | Two weeks |
| RC-SK-59 (CAIX−) Cells | | | | |
| G36-CD28z | 31 | 29 | 5 | 4 |
| G36-CD8z | 27 | 38 | 8 | 10 |
| A8-CD28z | 56 | 55 | 7 | 8 |
| LAK | 49 | 56 | 10 | 8 |

*Transduced T cells were incubated with irradiated tumor cells for one or two weeks then harvested, washed and incubated with fresh non-irradiated tumor cells overnight and supernatants collected after 24 hrs for cytokine analysis. For T cell cultures that did not interact with tumor cells, only background level of cytokines were detected at levels <50 pg/ml IFN-γ and <10 pg/ml IL-2.

TABLE 2

Frequency of Partial Regression of CAIX+ Tumors by G36-CD28z CART cells

| Gene construct | LAK | A8-CD28z | G36-CD28z | Statistics |
|---|---|---|---|---|
| Target antigen | none | irrelevant | specific | |
| Co-stimulatory | none | 2 signals | 2 signals | |
| Partial response | 2 | 1 | 10 | p < 0.005*; p < 0.001** |
| Non-partial response | 13 | 14 | 5 | N.S. |

Mice from experiments reported in FIG. 5 (experiment 1, n = 7 & experiment 2, n = 8) were scored for response at day 10. Partial response is defined as the regression of tumor to smaller than 30% volume of control tumor (same T-cell treatment in the same mouse bearing left flank of sk-rc-52 and right flank of control tumor sk-rc-59).
Fisher test results -
*G36-CD28z verses LAK;
**G36-CD28z verses A8-CD28z;
N.S.—no statistically significant relationship between number of tumors and partial response between T cells transduced with LAK and with A8-CD28z.

Example 9: Anti-Carbonic Anhydrase IX Chimeric Antigen Receptor T Cells Releasing Anti-PD-L1 Antibodies Revert T Cell Exhaustion and Regress Renal Cell Carcinoma in a Humanized Mouse Model Characterization of Anti-CAIX CAR T Cells Secreting Anti-PDL1 IgG1 or IgG4

In order to develop a new CAR therapy for CAIX+ CRC, we engineered a bicistronic lentiviral vector to express the anti-CAIX (G36) scFv linked to CD28 and CD3-ζ signaling domains (G36-CD28z CAR in the first cassette and anti-PD-L1 IgG1 or IgG4 in a second expression cassette after an IRES site (FIG. 16A). The anti-PD-L1 IgG sequence was inserted into the lentiviral vector with the aim to block T-cell exhaustion, which we propose may improve the efficacy of G36-CD28z CART cells (FIG. 16B). As controls, we used an anti-CAIX CAR or anti-BCMA CAR containing an irrelevant anti-SARS IgG1 mAb in the second cassette. The lentiviruses generated from these constructs were transduced into CD8 T cells and cultivated in the presence of IL-21, which yielded CART cells with modestly improved proliferation than was seen with IL-2 (FIGS. 21A and 21B), while maintaining the same specific killing activity for CAIX+ RCC (FIGS. 21C and 21D). The percentage of CAIX and PD-L1 expression in all RCC lineages used in our experiments is shown in the FIG. 22.

Figure 23:
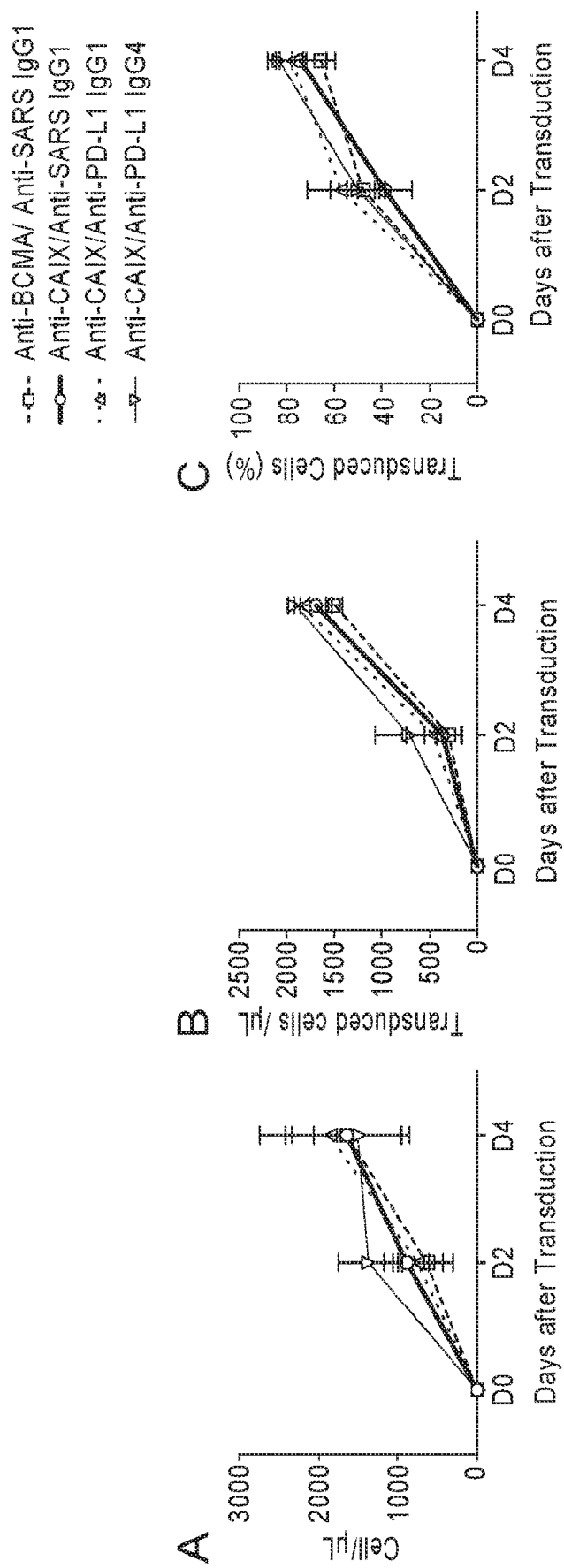
FIG. 23 is a series of graphs that depict the characterization of CART cells. (A) Proliferation of total CD8+ T cells two or four days after transduction Anti CAIX CAR/Anti-PD-L1 IgG1), (Anti-CAIX CAR/Anti-PD-L1 IgG4), Anti-CAIX CAR/Anti SARS IgG1) or Anti-BCMA CAR/Anti SARS IgG1). The CD8+ T cells were selected using Dynabeads™ CD8 Positive isolation Kit (Life Technologies) and activated with Dynabeads™ Human T Activator CD3/CD28 (Life Technologies) in the presence of IL-21 50 U/mL. IL-21 was added to the medium every 2 days. The proliferation was evaluated by FACS using Counting Beads (Molecular Probes). (B) Concentration of CAR-transduced T cells two and four days after transduction. The CART cells were incubated with human CAIX-Fc or BCMA-Fc, followed by incubation with an APC conjugated anti-human Fc IgG and analyzed by FACS. (C) Percentage of CART cells 2 and 4 days after transduction. The results represent the average±SD of three donors in duplicate.

The CART cell functionality is demonstrated in FIG. 23, where CD8 T cells transduced with all CARS were able to proliferate in the presence of IL-21 and anti-CD8/CD28 beads (FIGS. 23A and 23B), achieving transduction levels of 65-90% after four days (FIG. 23C). Fourteen days after transduction, we evaluated the stable long-term expression of CAR by the integrated lentiviruses (FIG. 16C), which was maintained around 25-50% for all CARs. Total IgG levels secreted by CD8 T cells was also determined, ranging around 300-650 ng/mL after 4 days (FIG. 16D). The binding specificity of the anti-PD-L1 IgG1 and IgG4 antibodies for human PD-L1 was also confirmed (FIG. 16E). The levels of biotinylated anti-PDL1 IgG1 and 4 were significantly lower than total IgG, which could be explained by the fact that a portion of the IgG was wasted during the purification process. The ability of anti-CAIX CART cells to undergo clonal expansion in the presence of CAIX+ RCC cells was established (FIGS. 16F and 16G). Anti-CAIX CART cells cannot expand significantly in the presence of CAIX– RCC cells.

Effector Activity of Anti-CAIX CART Cells. All anti-CAIX CART cells were able to induce around 50-70% decrease in the viability of Skrc59 CAIX+/PD-L1+, indicating that the Anti-PD-L1 IgG1 and IgG4, secreted by some CART cells, did not augment cell death under these assay conditions (FIG. 17A). Anti-CAIX CART cells induced IL-2 and IFNγ release in the presence of CAIX+/PD-L1+ cells, indicating the specific activation of anti-CAIX CART cells (FIGS. 17C and 17E, respectively). Regarding the anti-CAIX CART cells secreting anti-PD-L1 IgGs, the unique differential effect was seen for the IgG1 isoform, which was able to induce around 60% of ADCC in CAIX+/PD-L1+ RCC cells when incubated with natural killer cells (NK) (FIG. 17G). No effect in cell viability, cytokines secretion or ADCC was detected for any of the CART cells in the presence of CAIX–/PD-L1– cells (FIGS. 17B, 17D, 17F and 17H).

Anti-CAIX CART cells-secreting anti-PD-L1 antibodies can diminish T cell exhaustion in vitro. A circa 50% decrease in the exhaustion markers Lag-3, Tim3 and PD-1 was found in the anti-PD-L1 IgG1 and IgG4 anti-CAIX CART groups (FIGS. 18A, 18B and 18C, respectively) after induction of exhaustion compared to the parental anti-CAIX or irrelevant anti-BCMA CART cells. At this point, the killing activity of anti-CAIX CART cells without anti-PD-L1 was retested over Skrc59 CAIX+/PD-L1+ cells. As can be seen in FIG. 18D, the anti-CAIX CART cells had lost their killing activity against CAIX+/PD-L1+ RCC in vitro to a level that was similar to the irrelevant CAR group, establishing that the anti-CAIX CART cells became anergic. In contract, the RCC viability diminished 25-50% for the anti-CAIX CAR anti-PD-L1 IgG1 and IgG4 CART groups, thereby providing evidence that the checkpoint blockade elicited by the presence of secreted anti-PD-L1 IgGs can lead to diminished T cell exhaustion.

Figure 24:
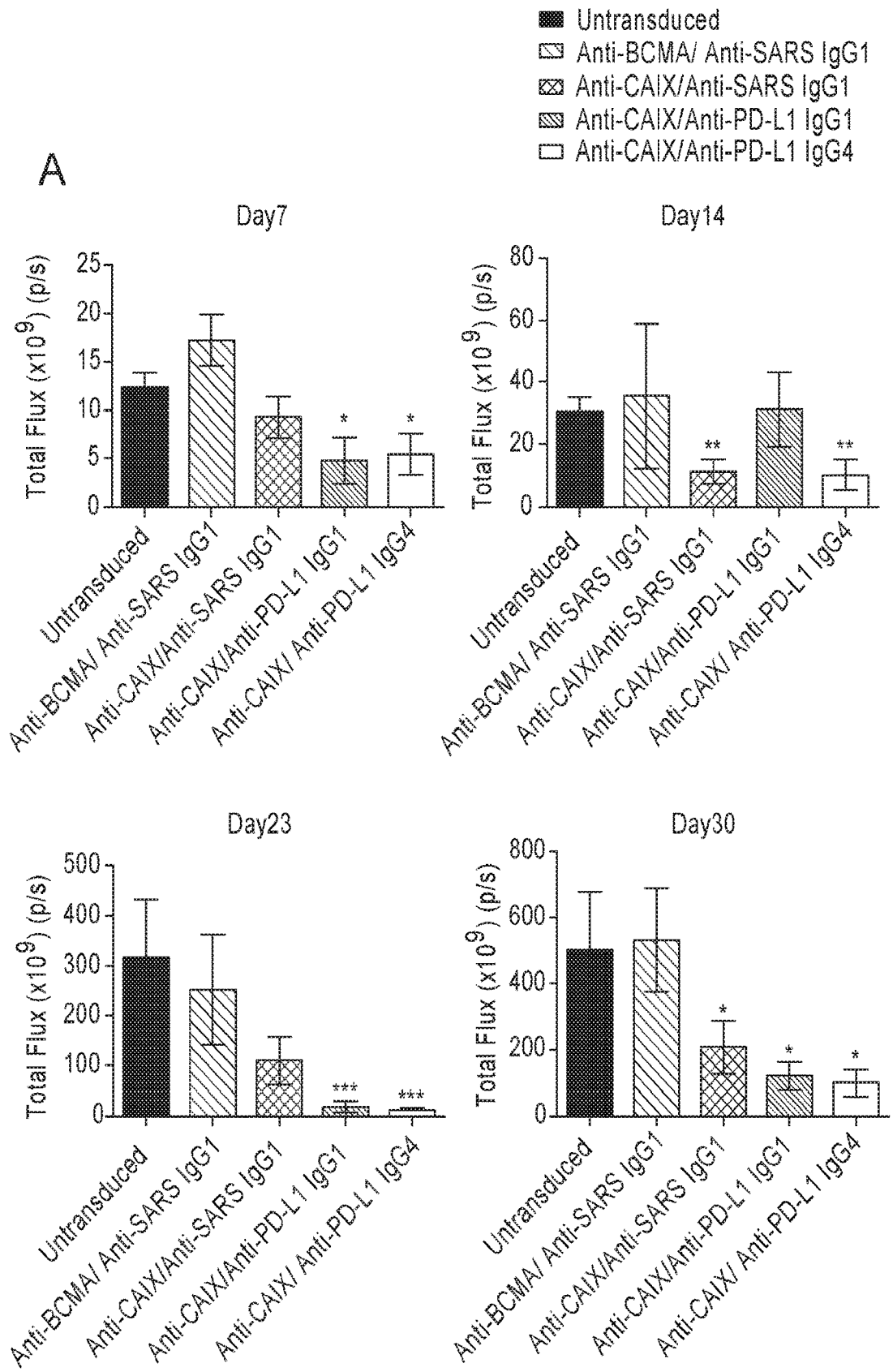
FIG. 24 is a series of graphs that depict the effect that CART cells have in an orthotopic model of human RCC. (A) Comparison of tumor size detected by bioluminescence versus days among the CART cells groups. NSG Mice (N=35) were injected in the renal capsule with 5.0×104 skrc-59 CAIX+, PD-L1+ and luciferase+RCC cells. After a week, the mice were injected with 1.0×107 CART or untransduced T cells IV. The CART cells were previously transduced with the following lentiviral sequences: Anti-BCMA CAR/Anti-SARS IgG1, Anti-CAIX CAR/Anti SARS IgG1, Anti-CAIX CAR/Anti-PD-L1 IgG1 and Anti-CAIX CAR/Anti-PD-L1 IgG4 (N=6 mice per group). The tumor bioluminescence was quantified after 5 minutes of luciferin IP injection using IVIS. In the Day 17, more 2.5×106 CART cells were injected. *P<0.05 compared to anti-BCMA CART cells. P<0.05 compared to untransduced T cells, *P<0.05 compared to Anti-CAIX/Anti-SARS IgG1. (B) Percentage of T cells in the mice blood after 8 days of treatment. *P<0.05 compared to untransduced T cells. **P<0.05 compared to all Anti-CAIX CARs. The red blood cells were lysed with ACK Lysing Buffer (Lonza™) and the remaining cells were stained with Pacific Blue conjugated Anti-human CD45 and analyzed by FACS. (C) Total tumor infiltrating lymphocytes (TIL) after 30 days of treatment with CART cells. The tumors and kidney from all mice were divided in two parts and one of them was fragmented in small pieces and digested with collagenase and DNAse to extraction of TIL. The cells were stained with Pacific Blue conjugated Anti-human CD45 and analyzed by FACS.
Figure 24:
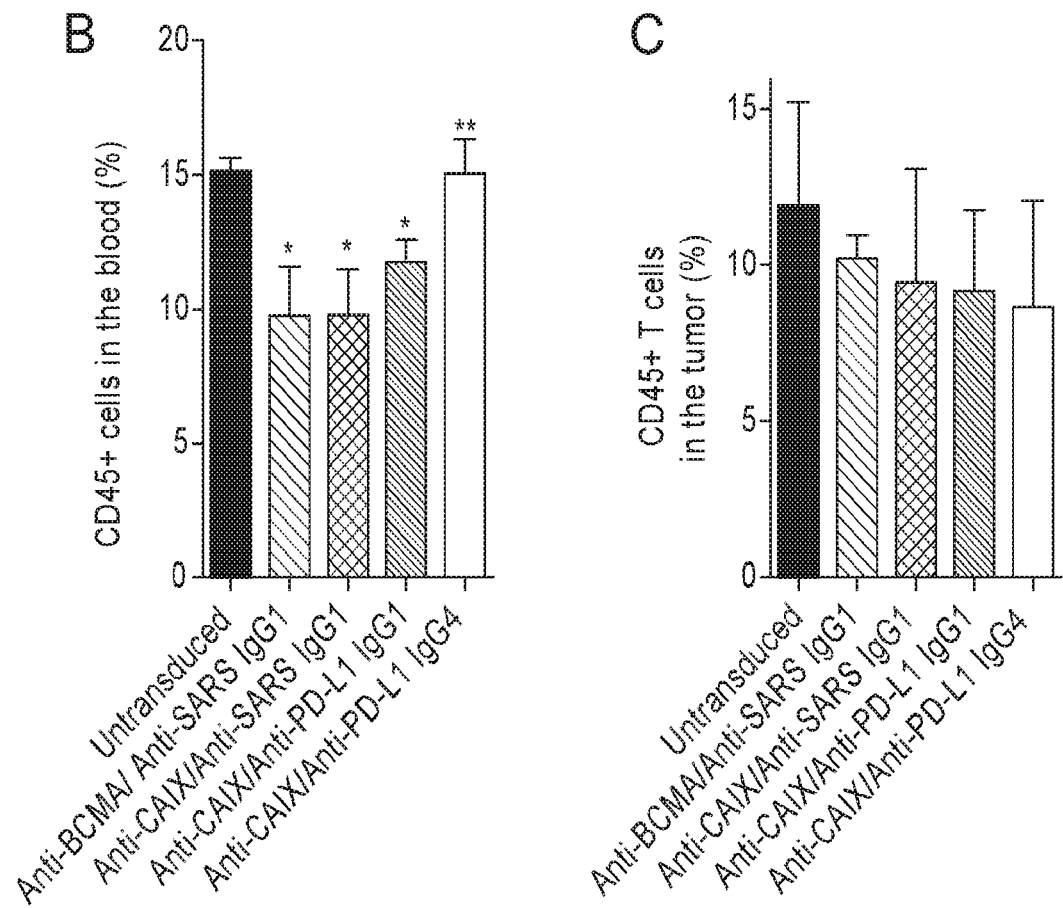

Anti-CAIX CART cells secreting anti-PD-L1 antibodies can further decrease tumor growth in an orthotopic mouse model of human RCC. NSG mice were used to establish an orthotopic RCC model by injecting Skrc-59 CAIX+PD-L1+luciferase+positive RCC cells under the kidney capsule followed by i.v. injection of $1.0 \times 10^7$ CART or untransduced T cells (Day 0) and repeat treatment on Day 17 with a lower dose ($2.5 \times 10^6$) of the same cells. We did not treat the mice with systemic IL-2 to maintain the proliferation of CART cells to avoid the bias that this molecule could exert over the tumor growth. The data in FIGS. 19A-19C demonstrate that all three anti-CAIX CART cell groups showed decreased RCC growth compared to irrelevant anti-BCMA CART cells or untransduced cells over the course of the experiment with the marked anti-tumor effects of the anti-CAEX CART cells secreting anti-PD-L1 IgG1 or IgG4 becoming evident at day 23 and 30 (FIGS. 19A and 19B). However, even one week after i.v. treatment with CART cells, we observed that the tumors were 2-3 times smaller in the anti-PD-L1-secreting CART cells when compared with parental anti-CAIX CART cells and the two control groups (FIG. 24A). We also analyzed CD45+ T cell survival in the mouse blood to gauge their survival in this passive transfer model. At Day 8 we observed that the amount of human T cells within the PBMCs was only 10-15% (FIG. 24B) and for this reason we decided to expand the CART cells in vitro to perform a second injection into the mail blood at Day 17. One week after the second injection (Day 23) the anti-PD-L1 IgG1 and IgG4 groups had tumors 15 times smaller than the control groups and 5 times smaller than the anti-CAIX CAR T cells without anti-PD-L1 secretion (FIG. 19C and FIG. 24A). At day 30, the group of mice treated with CART cells-secreting anti-PD-L1 antibody had tumors 5 times smaller than the control groups (FIG. 19C and FIG. 24A). The excised tumors weights were also lower from the mice treated CART cells-secreting anti-PD-L1 antibody and that was particularly evident for the anti-PDL1 IgG4 antibody group (FIGS. 19B and 19D).

Analysis of CART cell tumor infiltrates and evidence that anti-CAIX CART cells secreting anti-PD-L1 antibodies can lead to reversal of T cell exhaustion. Analysis in the excised tumors showed around 10% of TIL in all groups (FIG. 24C)

One of the most important effects observed with the anti-CAIX CART cells secreting anti-PD-L1 IgG1 or IgG4 antibodies in vivo was their ability to decrease the expression of the exhaustion markers PD-1, Tim-3 and Lag-3. As shown in FIG. 20A, we observed a circa 40-50% decrease in the expression of these markers in the TIL's when compared with the treatment using untransduced control cells at the Day 30 There was also a circa 30-70% decrease compared to anti-CAIX CAR cells That were not secreting anti-PDL-1 antibodies thereby providing evidence that the locally secreted antibodies had an effect on decreasing T cell exhaustion.

The effector activity of CART cells and their influence over RCC proliferation in vivo was evaluated by the immunohistochemical detection of granzyme B in the TIL, the tumor proliferation marker Ki67 and the tumor immunosuppressive proteinPD-L1 (FIGS. 20B and 20C). The granzyme B staining showed the effector activity of $CD8^+$ cells, especially in the RCC tumors treated with the anti-CAIX CART cells secreting anti-PD-L1 IgG4, which presented an augmented percentage of high positive stained cells (FIGS. 20B and 20C). PD-L1 expression decreased dramatically in the tumors treated with Antianti-CAIX CART cells, being more expressive in the Anti-CAIX/Anti-PD-L1 IgG-secreting groups (FIGS. 20B and 20C). Ki67 expression decreased significantly in the Anti-CAIX/Anti-PD-L1 IgG-secreting groups, as we can visualize in the total DAB pixel count graph, however when the intensity among the positive nuclei staining (Ki67 IHC quantification graph) was evaluated, we can note that the Anti-CAIX/Anti-PD-L1 IgG4 presented the lowest intensity of Ki67 expression (FIGS. 20B and 20C). For the quantification of nuclear proteins, like Ki67, DAB staining pattern is confined to the nuclei, and the threshold feature of ImageJ should be used to select the positive stained areas for quantification. For this reason, there are no negative cells in the Ki67 IHC quantification graph (FIG. 20C) and DAB pixel count were also shown for evaluation of total Ki67 staining, including negative cells (FIG. 20C).

Figure 25:
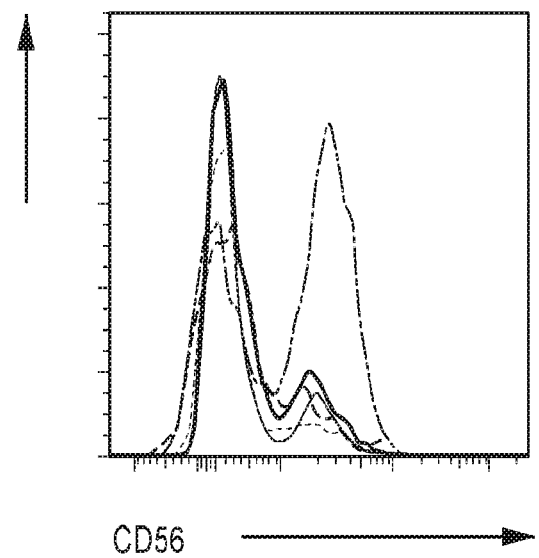
FIGS. 25A and 25B are a series of graphs and histological images that depict Human natural killer (NK) cells in the tumors treated with Anti-CAIX CART cells releasing anti-PD-L1 IgG1 Ab. (A) Percentage of CD56+ cells (NK marker) in the tumors. Two mice of each group were injected with 4.5×106 NK cells one day before the euthanasia. The kidney tumors from all mice were divided in two parts and one of them was fragmented in small pieces and digested with collagenase and DNAse to extraction of NK. NK cells present in the tumor were stained with APC-Anti-CD56 Ab and analyzed by FACS. *P<0.05. (B) CD56+ cells into the excised tumors detected by IHC and quantified using IHC Profiler Plugin of ImageJ Software. Four-micrometer sections of formalin-fixed, paraffin-embedded tissues were dewaxed and rehydrated in a decreasing ethanol series. Endogenous peroxidase activity was quenched using 3% hydrogen peroxide. The antigen retrieval was performed using pressure cooker in citrate buffer (pH=6.0) for 45 seconds at 123° C., 15 PSI. The tissue sections were incubated for 45 minutes with the rabbit anti-human CD56 mAb 1:100 (Abcam, ab133345), followed by secondary HRP conjugated anti-rabbit or anti-mouse Ab. The slides were developed using 3,3'-diaminobenzidine (DAB) and counterstained with hematoxylin. The images were obtained in an Olympus BX51 microscopy using a DP71 digital camera (Olympus) and analyzed in the DP Controller Software (Olympus). The quantification was performed using the IHC Profiler Plugin of ImageJ Software (23). The scale bars represent the magnification of the images (400×). *P<0.05 compared with untransduced, **P<0.05 compared with untransduced and Anti-BCMA/Anti-SARS IgG1.
Figure 25:
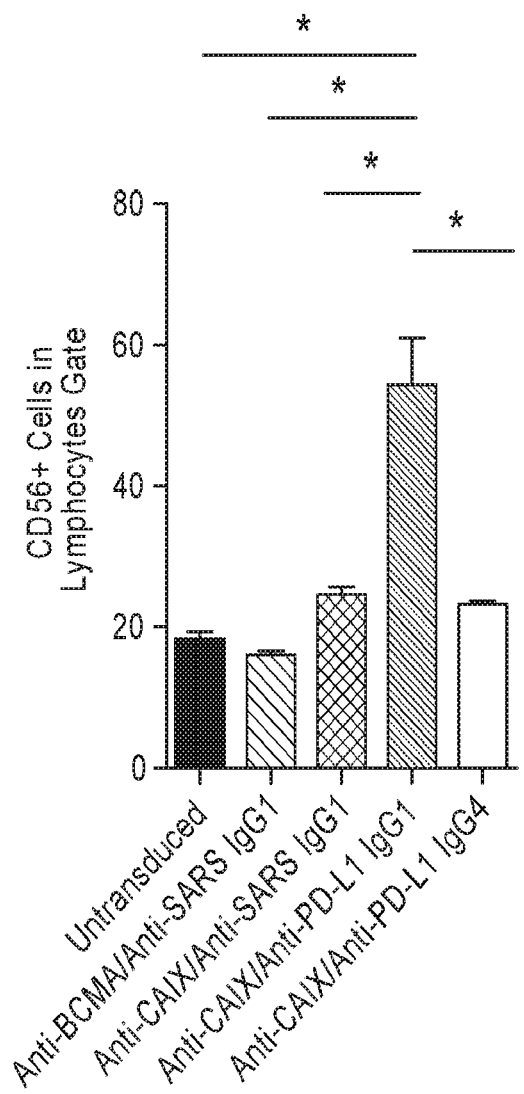
Figure 25:
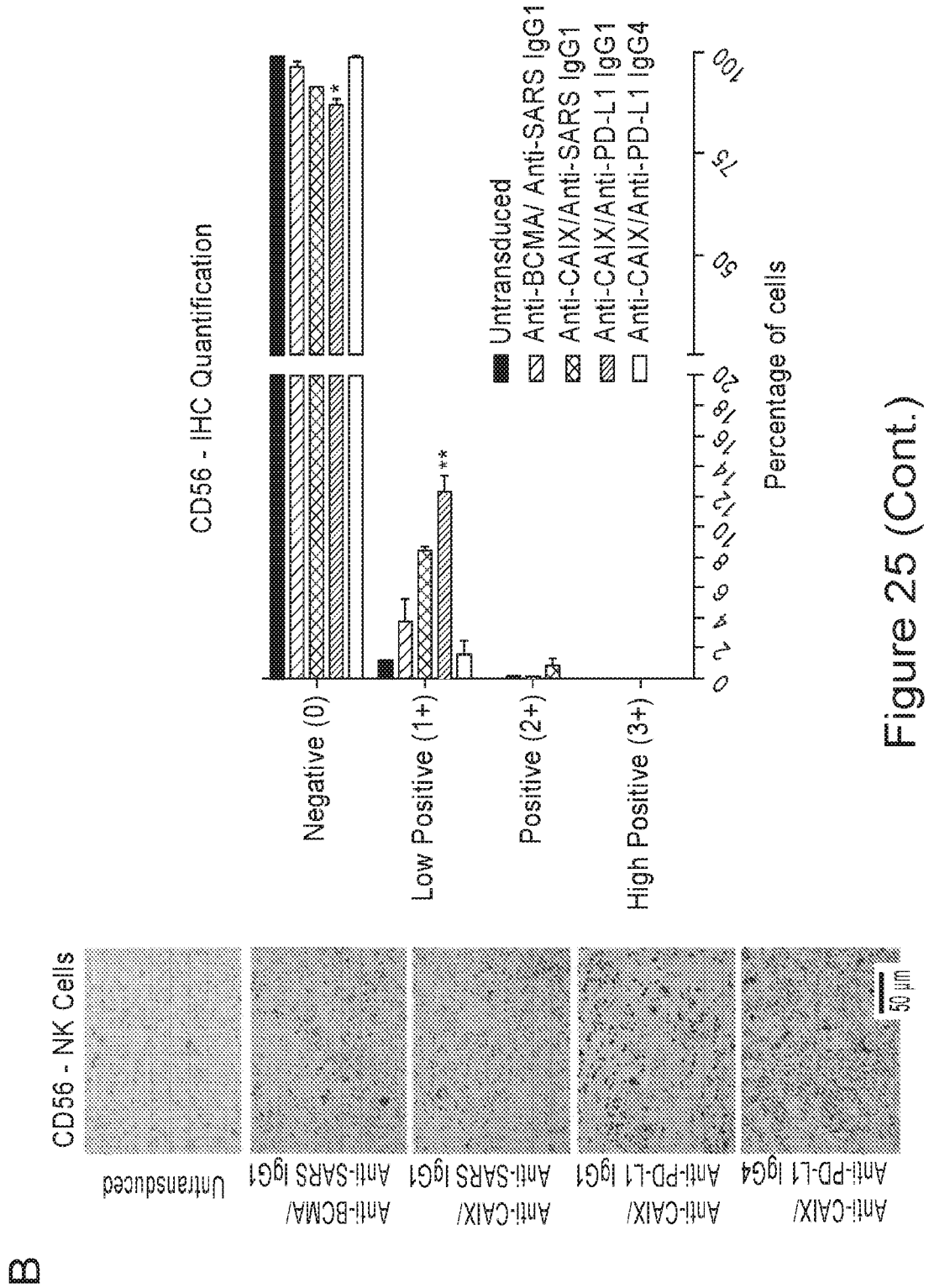

Anti-CAIX CART cells secreting anti-PD-L1 IgG1 antibodies can recruit NK cells to the tumor. The tumors of the mice treated with Anti-CAIX/Anti-PD-L1 IgG1 that received an injection of NK cells 2 days before the euthanasia showed the presence of 40% more NK cells inside the tumor, when compared with Anti-BCMA/Anti-SARS IgG1, as detected by Anti-CD56 staining by FACS (FIG. 25A). The increase in NK cells in the Anti-CAIX/Anti-PD-L1 IgG1 group was also detected and quantified by IHC (FIG. 25B). Very few NK cells were also detected in the groups treated with CART cells secreting an unspecific IgG1 Ab.

OTHER EMBODIMENTS

While the invention has been described in conjunction with the detailed description thereof, the foregoing description is intended to illustrate and not limit the scope of the invention, which is defined by the scope of the appended claims. Other aspects, advantages, and modifications are within the scope of the following claims.

REFERENCES

1. Ivanov S, Liao S Y, Ivanova A, Danilkovitch-Miagkova A, Tarasova N, Weirich G et al. Expression of hypoxia-inducible cell-surface transmembrane carbonic anhydrases in human cancer. *Am J Pathol* 2001; 158(3): 905-19.
2. Loncaster J A, Harris A L, Davidson S E, Logue J P, Hunter R D, Wycoff C C et al. Carbonic anhydrase (CA IX) expression, a potential new intrinsic marker of hypoxia: correlations with tumor oxygen measurements and prognosis in locally advanced carcinoma of the cervix. *Cancer research* 2001; 61(17): 6394-9.
3. Hilvo M, Baranauskiene L, Salzano A M, Scaloni A, Matulis D, Innocenti A et al. Biochemical characterization of CA IX, one of the most active carbonic anhydrase isozymes. *J Biol Chem* 2008; 283(41): 27799-809.
4. Oosterwijk E, Ruiter D J, Hoedemaeker P J, Pauwels E K, Jonas U, Zwartendijk J et al. Monoclonal antibody G 250 recognizes a determinant present in renal-cell carcinoma and absent from normal kidney. *International journal of cancer. Journal international du cancer* 1986; 38(4): 489-94.
5. Liao S Y, Brewer C, Zavada J, Pastorek J, Pastorekova S, Manetta A et al. Identification of the MN antigen as a diagnostic biomarker of cervical intraepithelial squamous and glandular neoplasia and cervical carcinomas. *Am J Pathol* 1994; 145(3): 598-609.
6. Liao S Y, Aurelio O N, Jan K, Zavada J, Stanbridge E J. Identification of the MN/CA9 protein as a reliable diagnostic biomarker of clear cell carcinoma of the kidney. *Cancer research* 1997; 57(14): 2827-31.
7. Atkins M, Regan M, McDermott D, Mier J, Stanbridge E, Youmans A et al. Carbonic anhydrase IX expression predicts outcome of interleukin 2 therapy for renal cancer. *Clin Cancer Res* 2005; 11(10): 3714-21.
8. Lokich J. Spontaneous regression of metastatic renal cancer. Case report and literature review. *Am J Clin Oncol* 1997; 20(4): 416-8.
9. Chang A E, Li Q, Jiang G, Sayre D M, Braun T M, Redman B G. Phase II trial of autologous tumor vaccination, anti-CD3-activated vaccine-primed lymphocytes, and interleukin-2 in stage IV renal cell cancer. *J Clin Oncol* 2003; 21(5): 884-90.
10. Dudley M E, Wunderlich J R, Robbins P F, Yang J C, Hwu P, Schwartzentruber D J et al. Cancer regression and autoimmunity in patients after clonal repopulation with antitumor lymphocytes. *Science* 2002; 298(5594): 850-4.
11. Schaft N, Willemsen R A, de Vries J, Lankiewicz B, Essers B W, Gratama J W et al. Peptide fine specificity of anti-glycoprotein 100 CTL is preserved following transfer of engineered TCR alpha beta genes into primary human T lymphocytes. *J Immunol* 2003; 170(4): 2186-94.
12. Bubenik J. MHC class I down-regulation: tumour escape from immune surveillance? (review). *International journal of oncology* 2004; 25(2): 487-91.
13. Gajewski T F, Meng Y, Blank C, Brown I, Kacha A, Kline J et al. Immune resistance orchestrated by the tumor microenvironment. *Immunological reviews* 2006; 213: 131-45.
14. Frigola X, Inman B A, Lohse C M, Krco C J, Cheville J C, Thompson R H et al. Identification of a soluble form of B7-H1 that retains immunosuppressive activity and is associated with aggressive renal cell carcinoma. *Clin Cancer Res* 2011; 17(7): 1915-23.
15. Grepin R, Guyot M, Giuliano S, Boncompagni M, Ambrosetti D, Chamorey E et al. The CXCL7/CXCR1/2 axis is a key driver in the growth of clear cell renal cell carcinoma. *Cancer research* 2014; 74(3): 873-83.
16. Sadelain M, Brentjens R, Riviere I. The promise and potential pitfalls of chimeric antigen receptors. *Curr Opin Immunol* 2009; 21(2): 215-23.
17. Lamers C H, Sleijfer S, van Steenbergen S, van Elzakker P, van Krimpen B, Groot C et al. Treatment of metastatic renal cell carcinoma with CAIX CAR-engineered T cells: clinical evaluation and management of on-target toxicity. *Molecular therapy: the journal of the American Society of Gene Therapy* 2013; 21(4): 904-12.
18. Milone M C, Fish J D, Carpenito C, Carroll R G, Binder G K, Teachey D et al. Chimeric receptors containing CD137 signal transduction domains mediate enhanced survival of T cells and increased antileukemic efficacy in vivo. *Molecular therapy: the journal of the American Society of Gene Therapy* 2009; 17(8): 1453-64.
19. Wilkie S, Picco G, Foster J, Davies D M, Julien S, Cooper L et al. Retargeting of human T cells to tumor-associated MUC1: the evolution of a chimeric antigen receptor. *J Immunol* 2008; 180(7): 4901-9.
20. Lo A S, Ma Q, Liu D L, Junghans R P. Anti-GD3 chimeric sFv-CD28/T-cell receptor zeta designer T cells for treatment of metastatic melanoma and other neuroectodermal tumors. *Clin Cancer Res* 2010; 16(10): 2769-80.
21. Kalos M, Levine B L, Porter D L, Katz S, Grupp S A, Bagg A et al. T cells with chimeric antigen receptors have potent antitumor effects and can establish memory in patients with advanced leukemia. *Science translational medicine* 2011; 3(95): 95ra73.
22. Pegram H J, Park J H, Brentjens R J. CD28z CARs and armored CARs. *Cancer J* 2014; 20(2): 127-33.
23. Xu C, Lo A, Yammanuru A, Tallarico A S, Brady K, Murakami A et al. Unique biological properties of catalytic domain directed human anti-CAIX antibodies discovered through phage-display technology. *PloS one* 2010; 5(3): e9625.
24. Sui J, Aird D R, Tamin A, Murakami A, Yan M, Yammanuru A et al. Broadening of neutralization activity to directly block a dominant antibody-driven SARS-coronavirus evolution pathway. *PLoS pathogens* 2008; 4(11): e1000197.
25. Mirzabekov T, Kontos H, Farzan M, Marasco W, Sodroski J. Paramagnetic proteoliposomes containing a pure, native, and oriented seven-transmembrane segment protein, CCR5. *Nat Biotechnol* 2000; 18(6): 649-54.
26. Wald O, Weiss I D, Wald H, Shoham H, Bar-Shavit Y, Beider K et al. IFN-gamma acts on T cells to induce NK cell mobilization and accumulation in target organs. *J Immunol* 2006; 176(8): 4716-29.
27. Zeytin H, Reali E, Zaharoff D A, Rogers C J, Schlom J, Greiner J W. Targeted delivery of murine IFN-gamma using a recombinant fowlpox virus: NK cell recruitment to regional lymph nodes and priming of tumor-specific host immunity. *Journal of interferon & cytokine research: the official journal of the International Society for Interferon and Cytokine Research* 2008; 28(2): 73-87.
28. Murugaiyan G, Saha B. Protumor vs antitumor functions of IL-17. *J Immunol* 2009; 183(7): 4169-75.
29. Bar E, Whitney P G, Moor K, Reis e Sousa C, LeibundGut-Landmann S. IL-17 regulates systemic fungal immunity by controlling the functional competence of NK cells. *Immunity* 2014; 40(1): 117-27.
30. Hinrichs C S, Kaiser A, Paulos C M, Cassard L, Sanchez-Perez L, Heemskerk B et al. Type 17 CD8+ T cells display enhanced antitumor immunity. *Blood* 2009; 114(3): 596-9.
31. Hombach A A, Rappl G, Abken H. Arming cytokine-induced killer cells with chimeric antigen receptors: CD28 outperforms combined CD28-OX40 "super-stimulation". *Molecular therapy: the journal of the American Society of Gene Therapy* 2013; 21(12): 2268-77.
32. Mor F, Cohen I R. IL-2 rescues antigen-specific T cells from radiation or dexamethasone-induced apoptosis. Correlation with induction of Bcl-2. *J Immunol* 1996; 156(2): 515-22.
33. Isakov N, Altman A. PKC-theta-mediated signal delivery from the TCR/CD28 surface receptors. *Frontiers in immunology* 2012; 3: 273.
34. Loskog A, Giandomenico V, Rossig C, Pule M, Dotti G, Brenner M K. Addition of the CD28 signaling domain to chimeric T-cell receptors enhances chimeric T-cell resistance to T regulatory cells. *Leukemia* 2006; 20(10): 1819-28.
35. Schwarzer A, Wolf B, Fisher J L, Schwaab T, Olek S, Baron U et al. Regulatory T-cells and associated pathways in metastatic renal cell carcinoma (mRCC) patients undergoing DC-vaccination and cytokine-therapy. *PloS one* 2012; 7(10): e46600.
36. Lamers C H, Willemsen R, van Elzakker P, van Steenbergen-Langeveld S, Broertjes M, Oosterwijk-Wakka J et al. Immune responses to transgene and retroviral vector in patients treated with ex vivo-engineered T cells. *Blood* 2011; 117(1): 72-82.
37. Miotti S, Negri D R, Valota O, Calabrese M, Bolhuis R L, Gratama J W et al. Level of anti-mouse-antibody response induced by bi-specific monoclonal antibody OC/TR in ovarian-carcinoma patients is associated with longer survival. *International journal of cancer. Journal international du cancer* 1999; 84(1): 62-8.
38. Kershaw M H, Westwood J A, Parker L L, Wang G, Eshhar Z, Mavroukakis S A et al. A phase I study on adoptive immunotherapy using gene-modified T cells for ovarian cancer. *Clin Cancer Res* 2006; 12(20 Pt 1): 6106-15.
39. Pastorekova S. Carbonic anhydrase IX (CA IX) as a potential target for cancer therapy. *Cancer Therapy* 2004; 2: 245-262.
40. Pastorekova S, Parkkila S, Parkkila A K, Opaysky R, Zelnik V, Saarnio J et al. Carbonic anhydrase IX, MN/CA IX: analysis of stomach complementary DNA sequence and expression in human and rat alimentary tracts. *Gastroenterology* 1997; 112(2): 398-408.
41. Saarnio J, Parkkila S, Parkkila A K, Waheed A, Casey M C, Zhou X Y et al. Immunohistochemistry of carbonic anhydrase isozyme IX (MN/CA IX) in human gut reveals polarized expression in the epithelial cells with the highest proliferative capacity. *The journal of histochemistry and cytochemistry: official journal of the Histochemistry Society* 1998; 46(4): 497-504.
42. Zavada J, Zavadova Z, Zat'ovicova M, Hyrsl L, Kawaciuk I. Soluble form of carbonic anhydrase IX (CA IX) in the serum and urine of renal carcinoma patients. *Br J Cancer* 2003; 89(6): 1067-71.
43. Hombach A, Koch D, Sircar R, Heuser C, Diehl V, Kruis W et al. A chimeric receptor that selectively targets membrane-bound carcinoembryonic antigen (mCEA) in the presence of soluble CEA. *Gene Ther* 1999; 6(2): 300-4.
44. Carpenito C, Milone M C, Hassan R, Simonet J C, Lakhal M, Suhoski M M et al. Control of large, established tumor xenografts with genetically retargeted human T cells containing CD28 and CD137 domains. *Proceedings of the National Academy of Sciences of the United States of America* 2009; 106(9): 3360-5.
45. Gill S, Tasian S K, Ruella M, Shestova O, Li Y, Porter D L et al. Efficacy against human acute myeloid leukemia and myeloablation of normal hematopoiesis in a mouse model using chimeric antigen receptor-modified T cells. *Blood* 2014.
46. Hombach A A, Heiders J, Foppe M, Chmielewski M, Abken H. OX40 costimulation by a chimeric antigen receptor abrogates CD28 and IL-2 induced IL-10 secretion by redirected CD4(+) T cells. *Oncoimmunology* 2012; 1(4): 458-466.
47. Song D G, Ye Q, Carpenito C, Poussin M, Wang L P, Ji C et al. In vivo persistence, tumor localization, and antitumor activity of CAR-engineered T cells is enhanced by costimulatory signaling through CD137 (4-1BB). *Cancer research* 2011; 71(13): 4617-27.
48. Bedke J, Stenzl A. Immunotherapeutic strategies for the treatment of renal cell carcinoma: where are we now? *Expert review of anticancer therapy* 2013; 13(12): 1399-408.
49. Bailey A, McDermott D F. Immune checkpoint inhibitors as novel targets for renal cell carcinoma therapeutics. *Cancer J* 2013; 19(4): 348-52.
50. Maher J, Brentjens R J, Gunset G, Riviere I, Sadelain M. Human T-lymphocyte cytotoxicity and proliferation directed by a single chimeric TCRzeta/CD28 receptor. *Nat Biotechnol* 2002; 20(1): 70-5.
51. Ferlay J, Soerjomataram I, Dikshit R, Eser S, Mathers C, Rebelo M, et al. Cancer incidence and mortality worldwide: sources, methods and major patterns in GLOBOCAN 2012. International journal of cancer. 2015; 136: E359-86.
52. Dutcher J P. Recent developments in the treatment of renal cell carcinoma. Therapeutic advances in urology. 2013; 5:338-53.
53. Cohen H T, McGovern F J. Renal-cell carcinoma. The New England journal of medicine. 2005; 353:2477-90.
54. Sedlakova O, Svastova E, Takacova M, Kopacek J, Pastorek J, Pastorekova S. Carbonic anhydrase IX, a hypoxia-induced catalytic component of the pH regulating machinery in tumors. Frontiers in physiology. 2014; 4:400.
55. Benej M, Pastorekova S, Pastorek J. Carbonic anhydrase IX: regulation and role in cancer. Sub-cellular biochemistry. 2014; 75:199-219.

56. Tostain J, Li G, Gentil-Perret A, Gigante M. Carbonic anhydrase 9 in clear cell renal cell carcinoma: a marker for diagnosis, prognosis and treatment. European journal of cancer. 2010; 46:3141-8.
57. Genega E M, Ghebremichael M, Najarian R, Fu Y, Wang Y, Argani P, et al. Carbonic anhydrase IX expression in renal neoplasms: correlation with tumor type and grade. American journal of clinical pathology. 2010; 134:873-9.
58. Alegre M L, Frauwirth K A, Thompson C B. T-cell regulation by CD28 and CTLA-4. Nature reviews Immunology. 2001; 1:220-8.
59. Pardoll D M. The blockade of immune checkpoints in cancer immunotherapy. Nature reviews Cancer. 2012; 12:252-64.
60. Harshman L C, Drake C G, Choueiri T K. PD-1 blockade in renal cell carcinoma: to equilibrium and beyond. Cancer immunology research. 2014; 2:1132-41.
61. Srivastava S, Riddell S R. Engineering CAR-T cells: Design concepts. Trends in immunology. 2015; 36:494-502.
62. Maude S L, Frey N, Shaw P A, Aplenc R, Barrett D M, Bunin N J, et al. Chimeric antigen receptor T cells for sustained remissions in leukemia. The New England journal of medicine. 2014; 371:1507-17.
63. Zhu Y, Tan Y, Ou R, Zhong Q, Zheng L, Du Y, et al. Anti-CD19 chimeric antigen receptor-modified T cells for B-cell malignancies: a systematic review of efficacy and safety in clinical trials. European journal of haematology. 2015.
64. Kakarla S, Gottschalk S. CAR T cells for solid tumors: armed and ready to go? Cancer journal. 2014; 20:151-5.
65. Lo A S, Xu C, Murakami A, Marasco W A. Regression of established renal cell carcinoma in nude mice using lentivirus-transduced human T-cells expressing a human anti-CAIX chimeric antigen receptor. Molecular Therapy—Oncolytics. 2014; 1:1-12.
66. Hsu C Y, Uludag H. A simple and rapid nonviral approach to efficiently transfect primary tissue-derived cells using polyethylenimine. Nature protocols. 2012; 7:935-45.
67. Singh H, Figliola M J, Dawson M J, Huls H, Olivares S, Switzer K, et al. Reprogramming CD19-specific T cells with IL-21 signaling can improve adoptive immunotherapy of B-lineage malignancies. Cancer research. 2011; 71:3516-27.
68. June C, Rosenberg S A, Sadelain M, Weber J S. T-cell therapy at the threshold. Nature biotechnology. 2012; 30:611-4.
69. Chang D K, Moniz R J, Xu Z, Sun J, Signoretti S, Zhu Q, et al. Human anti-CAIX antibodies mediate immune cell inhibition of renal cell carcinoma in vitro and in a humanized mouse model in vivo. Molecular cancer. 2015; 14:119.
70. Kaka A S, Shaffer D R, Hartmaier R, Leen A M, Lu A, Bear A, et al. Genetic modification of T cells with IL-21 enhances antigen presentation and generation of central memory tumor-specific cytotoxic T-lymphocytes. Journal of immunotherapy. 2009; 32:726-36.
71. Li Y, Bleakley M, Yee C. IL-21 influences the frequency, phenotype, and affinity of the antigen-specific CD8 T cell response. Journal of immunology. 2005; 175:2261-9.
72. van der Stegen S J, Hamieh M, Sadelain M. The pharmacology of second-generation chimeric antigen receptors. Nature reviews Drug discovery. 2015; 14:499-509.
73. Long A H, Haso W M, Shern J F, Wanhainen K M, Murgai M, Ingaramo M, et al. 4-1BB costimulation ameliorates T cell exhaustion induced by tonic signaling of chimeric antigen receptors. Nature medicine. 2015; 21:581-90.
74. Lee D W, Kochenderfer J N, Stetler-Stevenson M, Cui Y K, Delbrook C, Feldman S A, et al. T cells expressing CD19 chimeric antigen receptors for acute lymphoblastic leukaemia in children and young adults: a phase 1 dose-escalation trial. Lancet. 2015; 385:517-28.
75. Virgin H W, Wherry E J, Ahmed R. Redefining chronic viral infection. Cell. 2009; 138:30-50.
76. Wherry E J. T cell exhaustion. Nature immunology. 2011; 12:492-9.
77. Topalian S L, Hodi F S, Brahmer J R, Gettinger S N, Smith D C, McDermott D F, et al. Safety, activity, and immune correlates of anti-PD-1 antibody in cancer. The New England journal of medicine. 2012; 366:2443-54.
78. Brahmer J R, Tykodi S S, Chow L Q, Hwu W J, Topalian S L, Hwu P, et al. Safety and activity of anti-PD-L1 antibody in patients with advanced cancer. The New England journal of medicine. 2012; 366:2455-65.
79. John L B, Devaud C, Duong C P, Yong C S, Beavis P A, Haynes N M, et al. Anti-PD-1 antibody therapy potently enhances the eradication of established tumors by gene-modified T cells. Clinical cancer research: an official journal of the American Association for Cancer Research. 2013; 19:5636-46.

SEQUENCE LISTING (1686 sequences)

SEQ ID NO: 1 - protein, 8 aa, Artificial Sequence
  Description of Artificial Sequence: Synthetic peptide
GGPFSSYA

SEQ ID NO: 2 - protein, 8 aa, Artificial Sequence
  Description of Artificial Sequence: Synthetic peptide
GGIFSSYA

SEQ ID NO: 3 - protein, 8 aa, Artificial Sequence
  Description of Artificial Sequence: Synthetic peptide
GGTFSSYA

SEQ ID NO: 4 - protein, 8 aa, Artificial Sequence
  Description of Artificial Sequence: Synthetic peptide
GVTFSSYA

SEQ ID NO: 5 - protein, 8 aa, Artificial Sequence
  Description of Artificial Sequence: Synthetic peptide
GVTFSSYA

SEQ ID NO: 6 - protein, 8 aa, Artificial Sequence
  Description of Artificial Sequence: Synthetic peptide
GVTFSSYA

SEQ ID NO: 7 - protein, 8 aa, Artificial Sequence
  Description of Artificial Sequence: Synthetic peptide
GGTFSSYA

SEQ ID NO: 8 - protein, 8 aa, Artificial Sequence
  Description of Artificial Sequence: Synthetic peptide
GGTFSSYA

SEQ ID NO: 9 - protein, 8 aa, Artificial Sequence
  Description of Artificial Sequence: Synthetic peptide
GGTFSSYA

SEQ ID NO: 10 - protein, 8 aa, Artificial Sequence
  Description of Artificial Sequence: Synthetic peptide
GVTFSSYA

SEQ ID NO: 11 - protein, 8 aa, Artificial Sequence
  Description of Artificial Sequence: Synthetic peptide
GVTFRSYA

SEQ ID NO: 12 - protein, 8 aa, Artificial Sequence
  Description of Artificial Sequence: Synthetic peptide
GGTFSSYA

SEQ ID NO: 13 - protein, 8 aa, Artificial Sequence
  Description of Artificial Sequence: Synthetic peptide
GGPFSSYA

SEQ ID NO: 14 - protein, 8 aa, Artificial Sequence
  Description of Artificial Sequence: Synthetic peptide
GGTFSSYA

SEQ ID NO: 15 - protein, 8 aa, Artificial Sequence
  Description of Artificial Sequence: Synthetic peptide
GGTFSSYA

SEQ ID NO: 16 - protein, 8 aa, Artificial Sequence
  Description of Artificial Sequence: Synthetic peptide
GVTFSSYA

SEQ ID NO: 17 - protein, 8 aa, Artificial Sequence
  Description of Artificial Sequence: Synthetic peptide
GVTFSSYA

SEQ ID NO: 18 - protein, 8 aa, Artificial Sequence
  Description of Artificial Sequence: Synthetic peptide
GVTFSSYA

SEQ ID NO: 19 - protein, 8 aa, Artificial Sequence
  Description of Artificial Sequence: Synthetic peptide
GGPFSSYA

SEQ ID NO: 20 - protein, 8 aa, Artificial Sequence
  Description of Artificial Sequence: Synthetic peptide
GGPFSSYA

SEQ ID NO: 21 - protein, 8 aa, Artificial Sequence
  Description of Artificial Sequence: Synthetic peptide
GVTFSSYA

SEQ ID NO: 22 - protein, 8 aa, Artificial Sequence
  Description of Artificial Sequence: Synthetic peptide
GGTFSSYA

SEQ ID NO: 23 - protein, 8 aa, Artificial Sequence
  Description of Artificial Sequence: Synthetic peptide
GGTFSSYA

SEQ ID NO: 24 - protein, 8 aa, Artificial Sequence
  Description of Artificial Sequence: Synthetic peptide
GVTFSSYA

SEQ ID NO: 25 - protein, 8 aa, Artificial Sequence
  Description of Artificial Sequence: Synthetic peptide
GVTFSSYA

SEQ ID NO: 26 - protein, 8 aa, Artificial Sequence
  Description of Artificial Sequence: Synthetic peptide
GVTFSSYA

SEQ ID NO: 27 - protein, 8 aa, Artificial Sequence
  Description of Artificial Sequence: Synthetic peptide
GGTFSSYA

SEQ ID NO: 28 - protein, 8 aa, Artificial Sequence
  Description of Artificial Sequence: Synthetic peptide
GGIFSSYA

SEQ ID NO: 29 - protein, 8 aa, Artificial Sequence
  Description of Artificial Sequence: Synthetic peptide
GGTFSSYA

SEQ ID NO: 30 - protein, 8 aa, Artificial Sequence
  Description of Artificial Sequence: Synthetic peptide
GGTFSSYA

SEQ ID NO: 31 - protein, 8 aa, Artificial Sequence
  Description of Artificial Sequence: Synthetic peptide
GGTFSSYA

SEQ ID NO: 32 - protein, 8 aa, Artificial Sequence
  Description of Artificial Sequence: Synthetic peptide
GGTFSSYA

SEQ ID NO: 33 - protein, 8 aa, Artificial Sequence
  Description of Artificial Sequence: Synthetic peptide
GGTFSSYA

SEQ ID NO: 34 - protein, 8 aa, Artificial Sequence
  Description of Artificial Sequence: Synthetic peptide
GVTFRSYA

SEQ ID NO: 35 - protein, 8 aa, Artificial Sequence
  Description of Artificial Sequence: Synthetic peptide
GGTFSSYA

SEQ ID NO: 36 - protein, 8 aa, Artificial Sequence
  Description of Artificial Sequence: Synthetic peptide
GVTFSSYA

SEQ ID NO: 37 - protein, 8 aa, Artificial Sequence
  Description of Artificial Sequence: Synthetic peptide
ISPMFGTA

SEQ ID NO: 38 - protein, 8 aa, Artificial Sequence
  Description of Artificial Sequence: Synthetic peptide
ISPIFGTA

SEQ ID NO: 39 - protein, 8 aa, Artificial Sequence
  Description of Artificial Sequence: Synthetic peptide
ISPIFGTA

SEQ ID NO: 40 - protein, 8 aa, Artificial Sequence
  Description of Artificial Sequence: Synthetic peptide
ISPIFGTA

SEQ ID NO: 41 - protein, 8 aa, Artificial Sequence
  Description of Artificial Sequence: Synthetic peptide
IMPMFGTA

SEQ ID NO: 42 - protein, 8 aa, Artificial Sequence
  Description of Artificial Sequence: Synthetic peptide
ISPLFGTA

SEQ ID NO: 43 - protein, 8 aa, Artificial Sequence
  Description of Artificial Sequence: Synthetic peptide
ISPIFGTA

SEQ ID NO: 44 - protein, 8 aa, Artificial Sequence
  Description of Artificial Sequence: Synthetic peptide
ISPIFGTA

SEQ ID NO: 45 - protein, 8 aa, Artificial Sequence
  Description of Artificial Sequence: Synthetic peptide
ISPMFGTA

SEQ ID NO: 46 - protein, 8 aa, Artificial Sequence
  Description of Artificial Sequence: Synthetic peptide
ISPIFGTA

SEQ ID NO: 47 - protein, 8 aa, Artificial Sequence
  Description of Artificial Sequence: Synthetic peptide
ISGIFGTA

SEQ ID NO: 48 - protein, 8 aa, Artificial Sequence
  Description of Artificial Sequence: Synthetic peptide
ISPMFGTA

SEQ ID NO: 49 - protein, 8 aa, Artificial Sequence
  Description of Artificial Sequence: Synthetic peptide
ISGIFGTA

SEQ ID NO: 50 - protein, 8 aa, Artificial Sequence
  Description of Artificial Sequence: Synthetic peptide
ISPIFGTA

SEQ ID NO: 51 - protein, 8 aa, Artificial Sequence
  Description of Artificial Sequence: Synthetic peptide
ISPIFGTA

SEQ ID NO: 52 - protein, 8 aa, Artificial Sequence
  Description of Artificial Sequence: Synthetic peptide
ISPMFGTA

SEQ ID NO: 53 - protein, 8 aa, Artificial Sequence
  Description of Artificial Sequence: Synthetic peptide
ITPMFGTA

SEQ ID NO: 54 - protein, 8 aa, Artificial Sequence
  Description of Artificial Sequence: Synthetic peptide
ISPLFGTA

SEQ ID NO: 55 - protein, 8 aa, Artificial Sequence
  Description of Artificial Sequence: Synthetic peptide
ISPMFGTA

SEQ ID NO: 56 - protein, 8 aa, Artificial Sequence
  Description of Artificial Sequence: Synthetic peptide
ISPLFGTA

SEQ ID NO: 57 - protein, 8 aa, Artificial Sequence
  Description of Artificial Sequence: Synthetic peptide
ISPMFGTA

SEQ ID NO: 58 - protein, 8 aa, Artificial Sequence
  Description of Artificial Sequence: Synthetic peptide
ISPLFGTA

SEQ ID NO: 59 - protein, 8 aa, Artificial Sequence
  Description of Artificial Sequence: Synthetic peptide
ISPIFGTA

SEQ ID NO: 60 - protein, 8 aa, Artificial Sequence
  Description of Artificial Sequence: Synthetic peptide
ISPIFGTA

SEQ ID NO: 61 - protein, 8 aa, Artificial Sequence
  Description of Artificial Sequence: Synthetic peptide
ISPLFGTA

SEQ ID NO: 62 - protein, 8 aa, Artificial Sequence
  Description of Artificial Sequence: Synthetic peptide
ISPIFGTA

SEQ ID NO: 63 - protein, 8 aa, Artificial Sequence
  Description of Artificial Sequence: Synthetic peptide
ISPMFGTA

SEQ ID NO: 64 - protein, 8 aa, Artificial Sequence
  Description of Artificial Sequence: Synthetic peptide
ISPIFGTA

SEQ ID NO: 65 - protein, 8 aa, Artificial Sequence
  Description of Artificial Sequence: Synthetic peptide
ITPIFGTA

SEQ ID NO: 66 - protein, 8 aa, Artificial Sequence
  Description of Artificial Sequence: Synthetic peptide
ISPIFGTA

SEQ ID NO: 67 - protein, 8 aa, Artificial Sequence
  Description of Artificial Sequence: Synthetic peptide
IIPIFGTA

SEQ ID NO: 68 - protein, 8 aa, Artificial Sequence
  Description of Artificial Sequence: Synthetic peptide
ITPMFGTA

SEQ ID NO: 69 - protein, 8 aa, Artificial Sequence
  Description of Artificial Sequence: Synthetic peptide
ISAMFGTA

SEQ ID NO: 70 - protein, 8 aa, Artificial Sequence
  Description of Artificial Sequence: Synthetic peptide
IIPIFGTA

SEQ ID NO: 71 - protein, 8 aa, Artificial Sequence
  Description of Artificial Sequence: Synthetic peptide
ITPMFGTA

SEQ ID NO: 72 - protein, 8 aa, Artificial Sequence
  Description of Artificial Sequence: Synthetic peptide
ISPMFGTA

SEQ ID NO: 73 - protein, 17 aa, Artificial Sequence
  Description of Artificial Sequence: Synthetic peptide
ARDDGYAPSGGLREFDV

SEQ ID NO: 74 - protein, 14 aa, Artificial Sequence
  Description of Artificial Sequence: Synthetic peptide
ARGRGAYMGPSMDV

SEQ ID NO: 75 - protein, 14 aa, Artificial Sequence
  Description of Artificial Sequence: Synthetic peptide
ARGARYYAGGYFDV

SEQ ID NO: 76 - protein, 18 aa, Artificial Sequence
  Description of Artificial Sequence: Synthetic peptide
ARDSGNYDGYGPGSRFDV

SEQ ID NO: 77 - protein, 14 aa, Artificial Sequence
  Description of Artificial Sequence: Synthetic peptide
ARERGSWSFGYFDV

SEQ ID NO: 78 - protein, 14 aa, Artificial Sequence
  Description of Artificial Sequence: Synthetic peptide
ARSRTYADGRTFDV

SEQ ID NO: 79 - protein, 17 aa, Artificial Sequence
  Description of Artificial Sequence: Synthetic peptide
ARELGYLAGSPSPGFDY

SEQ ID NO: 80 - protein, 14 aa, Artificial Sequence
  Description of Artificial Sequence: Synthetic peptide
ARSRRYWADGGFDY

SEQ ID NO: 81 - protein, 15 aa, Artificial Sequence
  Description of Artificial Sequence: Synthetic peptide
AREGGYSPGGVDFDY

SEQ ID NO: 82 - protein, 14 aa, Artificial Sequence
  Description of Artificial Sequence: Synthetic peptide
ARGTTYSTARYFDV

SEQ ID NO: 83 - protein, 14 aa, Artificial Sequence
  Description of Artificial Sequence: Synthetic peptide
ARSPAYYFGPNMDV

SEQ ID NO: 84 - protein, 16 aa, Artificial Sequence
  Description of Artificial Sequence: Synthetic peptide
ARSSRYAPSDSTNFDQ

SEQ ID NO: 85 - protein, 14 aa, Artificial Sequence
  Description of Artificial Sequence: Synthetic peptide
ARGDRFYVGERFDV

SEQ ID NO: 86 - protein, 18 aa, Artificial Sequence
  Description of Artificial Sequence: Synthetic peptide
ARGGGVGRIWIAGYGFDQ

SEQ ID NO: 87 - protein, 18 aa, Artificial Sequence
  Description of Artificial Sequence: Synthetic peptide
ARGPGYHPAGASGQFFDL

SEQ ID NO: 88 - protein, 16 aa, Artificial Sequence
  Description of Artificial Sequence: Synthetic peptide
ARGRGYAPDALTNFDV

SEQ ID NO: 89 - protein, 15 aa, Artificial Sequence
  Description of Artificial Sequence: Synthetic peptide
ARGRGYIAVAGDMDV

SEQ ID NO: 90 - protein, 17 aa, Artificial Sequence
  Description of Artificial Sequence: Synthetic peptide
ARGDAYYVGGGARPFDL

SEQ ID NO: 91 - protein, 18 aa, Artificial Sequence
  Description of Artificial Sequence: Synthetic peptide
ARGYSYYPGGGGGRNFDY

SEQ ID NO: 92 - protein, 17 aa, Artificial Sequence
  Description of Artificial Sequence: Synthetic peptide
ARAPTYYASRDSYNFDY

SEQ ID NO: 93 - protein, 14 aa, Artificial Sequence
  Description of Artificial Sequence: Synthetic peptide
ARDTTYIAGGHFDV

SEQ ID NO: 94 - protein, 15 aa, Artificial Sequence
  Description of Artificial Sequence: Synthetic peptide
ARASGYFTGWGTFDY

SEQ ID NO: 95 - protein, 14 aa, Artificial Sequence
  Description of Artificial Sequence: Synthetic peptide
ARGRYYYTVGVYDV

SEQ ID NO: 96 - protein, 20 aa, Artificial Sequence
  Description of Artificial Sequence: Synthetic peptide
ARGGGYSADGGAGNNTIFDV

SEQ ID NO: 97 - protein, 15 aa, Artificial Sequence
  Description of Artificial Sequence: Synthetic peptide
ARERGYTVGGGGMDV

SEQ ID NO: 98 - protein, 17 aa, Artificial Sequence
  Description of Artificial Sequence: Synthetic peptide
AREYLGDDYSSGSYFDV

SEQ ID NO: 99 - protein, 14 aa, Artificial Sequence
  Description of Artificial Sequence: Synthetic peptide
ARESGYSGTGQFDV

SEQ ID NO: 100 - protein, 15 aa, Artificial Sequence
  Description of Artificial Sequence: Synthetic peptide
ARSGGYYDYGVGYDQ

SEQ ID NO: 101 - protein, 15 aa, Artificial Sequence
  Description of Artificial Sequence: Synthetic peptide
ARSGGYSPSIGGFDV

SEQ ID NO: 102 - protein, 16 aa, Artificial Sequence
  Description of Artificial Sequence: Synthetic peptide
ARGPGYDPSSLRGFDV

SEQ ID NO: 103 - protein, 10 aa, Artificial Sequence
  Description of Artificial Sequence: Synthetic peptide
ARGEEAYYDL

SEQ ID NO: 104 - protein, 15 aa, Artificial Sequence
  Description of Artificial Sequence: Synthetic peptide
ARGTSYLPGRSGFDV

SEQ ID NO: 105 - protein, 15 aa, Artificial Sequence
  Description of Artificial Sequence: Synthetic peptide
ARGRGYDPSVGGFDV

SEQ ID NO: 106 - protein, 20 aa, Artificial Sequence
  Description of Artificial Sequence: Synthetic peptide
ARDSTPSVTSSLYRIPAFDV

SEQ ID NO: 107 - protein, 15 aa, Artificial Sequence
  Description of Artificial Sequence: Synthetic peptide
ARGPGYYPDSNNYDL

SEQ ID NO: 108 - protein, 15 aa, Artificial Sequence
  Description of Artificial Sequence: Synthetic peptide
ARGGTYSPGGTYFDV

SEQ ID NO: 109 - protein, 12 aa, Artificial Sequence
  Description of Artificial Sequence: Synthetic peptide
RSVLYSSNNKNY

SEQ ID NO: 110 - protein, 6 aa, Artificial Sequence
  Description of Artificial Sequence: Synthetic peptide
NIGSKS

SEQ ID NO: 111 - protein, 6 aa, Artificial Sequence
  Description of Artificial Sequence: Synthetic peptide
QTVSNY

SEQ ID NO: 112 - protein, 8 aa, Artificial Sequence
  Description of Artificial Sequence: Synthetic peptide
SSNIGSNT

SEQ ID NO: 113 - protein, 6 aa, Artificial Sequence
  Description of Artificial Sequence: Synthetic peptide
HIGSKS

SEQ ID NO: 114 - protein, 9 aa, Artificial Sequence
  Description of Artificial Sequence: Synthetic peptide
SSDVGGYNH

SEQ ID NO: 115 - protein, 9 aa, Artificial Sequence
  Description of Artificial Sequence: Synthetic peptide
SSDVGGYNY

SEQ ID NO: 116 - protein, 8 aa, Artificial Sequence
  Description of Artificial Sequence: Synthetic peptide
SSNMGRNT

SEQ ID NO: 117 - protein, 8 aa, Artificial Sequence
  Description of Artificial Sequence: Synthetic peptide
SGSIASTY

SEQ ID NO: 118 - protein, 8 aa, Artificial Sequence
  Description of Artificial Sequence: Synthetic peptide
SGSIASNY

SEQ ID NO: 119 - protein, 9 aa, Artificial Sequence
  Description of Artificial Sequence: Synthetic peptide
SSNIGAGYD

SEQ ID NO: 120 - protein, 8 aa, Artificial Sequence
  Description of Artificial Sequence: Synthetic peptide
SGSIASNY

SEQ ID NO: 121 - protein, 6 aa, Artificial Sequence
  Description of Artificial Sequence: Synthetic peptide
DIGSKS

SEQ ID NO: 122 - protein, 9 aa, Artificial Sequence
  Description of Artificial Sequence: Synthetic peptide
SGSVSTSNY

SEQ ID NO: 123 - protein, 8 aa, Artificial Sequence
  Description of Artificial Sequence: Synthetic peptide
SNNVGNQG

SEQ ID NO: 124 - protein, 12 aa, Artificial Sequence
  Description of Artificial Sequence: Synthetic peptide
RSLFDSSDNKNY

SEQ ID NO: 125 - protein, 12 aa, Artificial Sequence
  Description of Artificial Sequence: Synthetic peptide
RSVLYSSNNKNY

SEQ ID NO: 126 - protein, 8 aa, Artificial Sequence
  Description of Artificial Sequence: Synthetic peptide
SSNIGVNY

SEQ ID NO: 127 - protein, 8 aa, Artificial Sequence
  Description of Artificial Sequence: Synthetic peptide
SSNIGSNT

SEQ ID NO: 128 - protein, 7 aa, Artificial Sequence
  Description of Artificial Sequence: Synthetic peptide
QSVDRGY

SEQ ID NO: 129 - protein, 9 aa, Artificial Sequence
  Description of Artificial Sequence: Synthetic peptide
SSDIGAYNY

SEQ ID NO: 130 - protein, 6 aa, Artificial Sequence
  Description of Artificial Sequence: Synthetic peptide
ALPKQY

SEQ ID NO: 131 - protein, 8 aa, Artificial Sequence
  Description of Artificial Sequence: Synthetic peptide
SDNVGNQG

SEQ ID NO: 132 - protein, 8 aa, Artificial Sequence
  Description of Artificial Sequence: Synthetic peptide
NNNVGNQG

SEQ ID NO: 133 - protein, 9 aa, Artificial Sequence
  Description of Artificial Sequence: Synthetic peptide
SSDVGAHNF

SEQ ID NO: 134 - protein, 6 aa, Artificial Sequence
  Description of Artificial Sequence: Synthetic peptide
QSVDSH

SEQ ID NO: 135 - protein, 8 aa, Artificial Sequence
  Description of Artificial Sequence: Synthetic peptide
TSNVGRNT

SEQ ID NO: 136 - protein, 8 aa, Artificial Sequence
  Description of Artificial Sequence: Synthetic peptide
RSNIGSNT

SEQ ID NO: 137 - protein, 8 aa, Artificial Sequence
  Description of Artificial Sequence: Synthetic peptide
RSNIGRNT

SEQ ID NO: 138 - protein, 8 aa, Artificial Sequence
  Description of Artificial Sequence: Synthetic peptide
SNNVGNQG

SEQ ID NO: 139 - protein, 6 aa, Artificial Sequence
  Description of Artificial Sequence: Synthetic peptide
QSVSSF

SEQ ID NO: 140 - protein, 6 aa, Artificial Sequence
  Description of Artificial Sequence: Synthetic peptide
ALPKQY

SEQ ID NO: 141 - protein, 8 aa, Artificial Sequence
  Description of Artificial Sequence: Synthetic peptide
SGSIASNY

SEQ ID NO: 142 - protein, 7 aa, Artificial Sequence
  Description of Artificial Sequence: Synthetic peptide
NGPSNYI

SEQ ID NO: 143 - protein, 7 aa, Artificial Sequence
  Description of Artificial Sequence: Synthetic peptide
QSVSSSY

SEQ ID NO: 144 - protein, 8 aa, Artificial Sequence
  Description of Artificial Sequence: Synthetic peptide
SSNIGVSF

SEQ ID NO: 145 - protein, 3 aa, Artificial Sequence
  Description of Artificial Sequence: Synthetic peptide
WAS

SEQ ID NO: 146 - protein, 3 aa, Artificial Sequence
  Description of Artificial Sequence: Synthetic peptide
DDS

SEQ ID NO: 147 - protein, 3 aa, Artificial Sequence
  Description of Artificial Sequence: Synthetic peptide
AAS

SEQ ID NO: 148 - protein, 3 aa, Artificial Sequence
  Description of Artificial Sequence: Synthetic peptide
SNN

SEQ ID NO: 149 - protein, 3 aa, Artificial Sequence
  Description of Artificial Sequence: Synthetic peptide
SNN

SEQ ID NO: 150 - protein, 3 aa, Artificial Sequence
  Description of Artificial Sequence: Synthetic peptide
DVS

SEQ ID NO: 151 - protein, 3 aa, Artificial Sequence
  Description of Artificial Sequence: Synthetic peptide
EVT

SEQ ID NO: 152 - protein, 3 aa, Artificial Sequence
  Description of Artificial Sequence: Synthetic peptide
DND

SEQ ID NO: 153 - protein, 3 aa, Artificial Sequence
  Description of Artificial Sequence: Synthetic peptide
EDH

SEQ ID NO: 154 - protein, 3 aa, Artificial Sequence
  Description of Artificial Sequence: Synthetic peptide
EDN

SEQ ID NO: 155 - protein, 3 aa, Artificial Sequence
  Description of Artificial Sequence: Synthetic peptide
DNS

SEQ ID NO: 156 - protein, 3 aa, Artificial Sequence
  Description of Artificial Sequence: Synthetic peptide
EDN

SEQ ID NO: 157 - protein, 3 aa, Artificial Sequence
  Description of Artificial Sequence: Synthetic peptide
DDI

SEQ ID NO: 158 - protein, 3 aa, Artificial Sequence
  Description of Artificial Sequence: Synthetic peptide
STN

SEQ ID NO: 159 - protein, 3 aa, Artificial Sequence
  Description of Artificial Sequence: Synthetic peptide
RNN

SEQ ID NO: 160 - protein, 3 aa, Artificial Sequence
  Description of Artificial Sequence: Synthetic peptide
WAS

SEQ ID NO: 161 - protein, 3 aa, Artificial Sequence
  Description of Artificial Sequence: Synthetic peptide
WAS

SEQ ID NO: 162 - protein, 3 aa, Artificial Sequence
  Description of Artificial Sequence: Synthetic peptide
RNN

SEQ ID NO: 163 - protein, 3 aa, Artificial Sequence
  Description of Artificial Sequence: Synthetic peptide
SNN

SEQ ID NO: 164 - protein, 3 aa, Artificial Sequence
  Description of Artificial Sequence: Synthetic peptide
GAS

SEQ ID NO: 165 - protein, 3 aa, Artificial Sequence
  Description of Artificial Sequence: Synthetic peptide
EVS

SEQ ID NO: 166 - protein, 3 aa, Artificial Sequence
  Description of Artificial Sequence: Synthetic peptide
KDS

SEQ ID NO: 167 - protein, 3 aa, Artificial Sequence
  Description of Artificial Sequence: Synthetic peptide
RDN

SEQ ID NO: 168 - protein, 3 aa, Artificial Sequence
  Description of Artificial Sequence: Synthetic peptide
RNN

SEQ ID NO: 169 - protein, 3 aa, Artificial Sequence
  Description of Artificial Sequence: Synthetic peptide
EVN

SEQ ID NO: 170 - protein, 3 aa, Artificial Sequence
  Description of Artificial Sequence: Synthetic peptide
GAS

SEQ ID NO: 171 - protein, 3 aa, Artificial Sequence
  Description of Artificial Sequence: Synthetic peptide
NDN

SEQ ID NO: 172 - protein, 3 aa, Artificial Sequence
  Description of Artificial Sequence: Synthetic peptide
SNN

SEQ ID NO: 173 - protein, 3 aa, Artificial Sequence
  Description of Artificial Sequence: Synthetic peptide
SNN

SEQ ID NO: 174 - protein, 3 aa, Artificial Sequence
  Description of Artificial Sequence: Synthetic peptide
KNN

SEQ ID NO: 175 - protein, 3 aa, Artificial Sequence
  Description of Artificial Sequence: Synthetic peptide
DAS

SEQ ID NO: 176 - protein, 3 aa, Artificial Sequence
  Description of Artificial Sequence: Synthetic peptide
KDT

SEQ ID NO: 177 - protein, 3 aa, Artificial Sequence
  Description of Artificial Sequence: Synthetic peptide
EDN

SEQ ID NO: 178 - protein, 7 aa, Artificial Sequence
  Description of Artificial Sequence: Synthetic peptide
LNSDGSH

SEQ ID NO: 179 - protein, 3 aa, Artificial Sequence
  Description of Artificial Sequence: Synthetic peptide
GAS

SEQ ID NO: 180 - protein, 3 aa, Artificial Sequence
  Description of Artificial Sequence: Synthetic peptide
RDD

SEQ ID NO: 181 - protein, 9 aa, Artificial Sequence
  Description of Artificial Sequence: Synthetic peptide
QQYYSGSWT

SEQ ID NO: 182 - protein, 11 aa, Artificial Sequence
  Description of Artificial Sequence: Synthetic peptide
QVWDRSSDHVV

SEQ ID NO: 183 - protein, 10 aa, Artificial Sequence
  Description of Artificial Sequence: Synthetic peptide
QQYDNLPPVT

SEQ ID NO: 184 - protein, 11 aa, Artificial Sequence
  Description of Artificial Sequence: Synthetic peptide
SAWDDSLGGEV

SEQ ID NO: 185 - protein, 11 aa, Artificial Sequence
  Description of Artificial Sequence: Synthetic peptide
QVWDSSNDHPV

SEQ ID NO: 186 - protein, 10 aa, Artificial Sequence
  Description of Artificial Sequence: Synthetic peptide
TSYAGSNSLV

SEQ ID NO: 187 - protein, 9 aa, Artificial Sequence
  Description of Artificial Sequence: Synthetic peptide
SSYAGGKWV

SEQ ID NO: 188 - protein, 11 aa, Artificial Sequence
  Description of Artificial Sequence: Synthetic peptide
AAWDDSLNGPV

SEQ ID NO: 189 - protein, 9 aa, Artificial Sequence
  Description of Artificial Sequence: Synthetic peptide
QSFDASTLV

SEQ ID NO: 190 - protein, 11 aa, Artificial Sequence
  Description of Artificial Sequence: Synthetic peptide
QSYDSDNHEVI

SEQ ID NO: 191 - protein, 11 aa, Artificial Sequence
  Description of Artificial Sequence: Synthetic peptide
QSYDSSLSVVV

SEQ ID NO: 192 - protein, 10 aa, Artificial Sequence
  Description of Artificial Sequence: Synthetic peptide
QSYDTSNRKV

SEQ ID NO: 193 - protein, 12 aa, Artificial Sequence
  Description of Artificial Sequence: Synthetic peptide
QVWDTNSDPVFV

SEQ ID NO: 194 - protein, 10 aa, Artificial Sequence
  Description of Artificial Sequence: Synthetic peptide
VLYMGSGISM

SEQ ID NO: 195 - protein, 11 aa, Artificial Sequence
  Description of Artificial Sequence: Synthetic peptide
SAWDSSLSAWV

SEQ ID NO: 196 - protein, 11 aa, Artificial Sequence
  Description of Artificial Sequence: Synthetic peptide
QQYFSSPPIFT

SEQ ID NO: 197 - protein, 9 aa, Artificial Sequence
  Description of Artificial Sequence: Synthetic peptide
QQYYSTPPT

SEQ ID NO: 198 - protein, 12 aa, Artificial Sequence
  Description of Artificial Sequence: Synthetic peptide
GVWDDSLNGHWV

SEQ ID NO: 199 - protein, 11 aa, Artificial Sequence
  Description of Artificial Sequence: Synthetic peptide
AAWDDSLKGRV

SEQ ID NO: 200 - protein, 9 aa, Artificial Sequence
  Description of Artificial Sequence: Synthetic peptide
QQYGSSRLS

SEQ ID NO: 201 - protein, 10 aa, Artificial Sequence
  Description of Artificial Sequence: Synthetic peptide
SSYAGSNNVV

SEQ ID NO: 202 - protein, 9 aa, Artificial Sequence
  Description of Artificial Sequence: Synthetic peptide
QAWDSSTAV

SEQ ID NO: 203 - protein, 11 aa, Artificial Sequence
  Description of Artificial Sequence: Synthetic peptide
SAWDSSLTAVV

SEQ ID NO: 204 - protein, 11 aa, Artificial Sequence
  Description of Artificial Sequence: Synthetic peptide
SAWDSSLSAWV

SEQ ID NO: 205 - protein, 11 aa, Artificial Sequence
  Description of Artificial Sequence: Synthetic peptide
AAWDDSLDGPV

SEQ ID NO: 206 - protein, 9 aa, Artificial Sequence
  Description of Artificial Sequence: Synthetic peptide
QQRSMWPLT

SEQ ID NO: 207 - protein, 11 aa, Artificial Sequence
  Description of Artificial Sequence: Synthetic peptide
SSWDDDLNGPV

SEQ ID NO: 208 - protein, 8 aa, Artificial Sequence
  Description of Artificial Sequence: Synthetic peptide
QSYDSSVV

SEQ ID NO: 209 - protein, 11 aa, Artificial Sequence
  Description of Artificial Sequence: Synthetic peptide
AAWDVSLNGQV

SEQ ID NO: 210 - protein, 11 aa, Artificial Sequence
  Description of Artificial Sequence: Synthetic peptide
SAWDSSLSDWV

SEQ ID NO: 211 - protein, 9 aa, Artificial Sequence
  Description of Artificial Sequence: Synthetic peptide
QQRFNWPPT

SEQ ID NO: 212 - protein, 10 aa, Artificial Sequence
  Description of Artificial Sequence: Synthetic peptide
QSADASENSV

SEQ ID NO: 213 - protein, 9 aa, Artificial Sequence
  Description of Artificial Sequence: Synthetic peptide
QSYDTSNLV

SEQ ID NO: 214 - protein, 10 aa, Artificial Sequence
  Description of Artificial Sequence: Synthetic peptide
ETWDSNTHVV

SEQ ID NO: 215 - protein, 9 aa, Artificial Sequence
  Description of Artificial Sequence: Synthetic peptide
QQVNSFPRT

SEQ ID NO: 216 - protein, 11 aa, Artificial Sequence
  Description of Artificial Sequence: Synthetic peptide
SAWDESLSSVL

SEQ ID NO: 217 - protein, 8 aa, Artificial Sequence
  Description of Artificial Sequence: Synthetic peptide
GGTFSSYA

SEQ ID NO: 218 - protein, 8 aa, Artificial Sequence
  Description of Artificial Sequence: Synthetic peptide
GVTFSSYA

SEQ ID NO: 219 - protein, 8 aa, Artificial Sequence
  Description of Artificial Sequence: Synthetic peptide
GGTFSSYA

SEQ ID NO: 220 - protein, 8 aa, Artificial Sequence
  Description of Artificial Sequence: Synthetic peptide
GGIFSSYA

SEQ ID NO: 221 - protein, 8 aa, Artificial Sequence
  Description of Artificial Sequence: Synthetic peptide
GVIFSSYA

SEQ ID NO: 222 - protein, 8 aa, Artificial Sequence
  Description of Artificial Sequence: Synthetic peptide
GGTFSSYA

SEQ ID NO: 223 - protein, 8 aa, Artificial Sequence
  Description of Artificial Sequence: Synthetic peptide
GGTFSSYA

SEQ ID NO: 224 - protein, 8 aa, Artificial Sequence
  Description of Artificial Sequence: Synthetic peptide
GGPFRSYA

SEQ ID NO: 225 - protein, 8 aa, Artificial Sequence
  Description of Artificial Sequence: Synthetic peptide
GVPFSSYA

SEQ ID NO: 226 - protein, 8 aa, Artificial Sequence
  Description of Artificial Sequence: Synthetic peptide
GVTFSSYA

SEQ ID NO: 227 - protein, 8 aa, Artificial Sequence
  Description of Artificial Sequence: Synthetic peptide
GVIFSSYA

SEQ ID NO: 228 - protein, 8 aa, Artificial Sequence
  Description of Artificial Sequence: Synthetic peptide
GVTFSSYA

SEQ ID NO: 229 - protein, 8 aa, Artificial Sequence
  Description of Artificial Sequence: Synthetic peptide
GGTFSSYA

SEQ ID NO: 230 - protein, 8 aa, Artificial Sequence
  Description of Artificial Sequence: Synthetic peptide
GGTFSSYA

SEQ ID NO: 231 - protein, 8 aa, Artificial Sequence
  Description of Artificial Sequence: Synthetic peptide
GGPFSSYA

SEQ ID NO: 232 - protein, 8 aa, Artificial Sequence
  Description of Artificial Sequence: Synthetic peptide
GGIFSSYA

SEQ ID NO: 233 - protein, 8 aa, Artificial Sequence
  Description of Artificial Sequence: Synthetic peptide
GGIFRSYA

SEQ ID NO: 234 - protein, 8 aa, Artificial Sequence
  Description of Artificial Sequence: Synthetic peptide
GGTFSSYA

SEQ ID NO: 235 - protein, 8 aa, Artificial Sequence
  Description of Artificial Sequence: Synthetic peptide
GVTFSSYA

SEQ ID NO: 236 - protein, 8 aa, Artificial Sequence
  Description of Artificial Sequence: Synthetic peptide
GGTFSSYA

SEQ ID NO: 237 - protein, 8 aa, Artificial Sequence
  Description of Artificial Sequence: Synthetic peptide
GGTFRSYA

SEQ ID NO: 238 - protein, 8 aa, Artificial Sequence
  Description of Artificial Sequence: Synthetic peptide
GGTFSSYA

SEQ ID NO: 239 - protein, 8 aa, Artificial Sequence
  Description of Artificial Sequence: Synthetic peptide
GGPFSSYA

SEQ ID NO: 240 - protein, 8 aa, Artificial Sequence
  Description of Artificial Sequence: Synthetic peptide
GVTFSSYA

SEQ ID NO: 241 - protein, 8 aa, Artificial Sequence
  Description of Artificial Sequence: Synthetic peptide
GGTFSSYA

SEQ ID NO: 242 - protein, 8 aa, Artificial Sequence
  Description of Artificial Sequence: Synthetic peptide
GVTFRSYA

SEQ ID NO: 243 - protein, 8 aa, Artificial Sequence
  Description of Artificial Sequence: Synthetic peptide
GGTFSSYA

SEQ ID NO: 244 - protein, 8 aa, Artificial Sequence
  Description of Artificial Sequence: Synthetic peptide
GVTFSSYA

SEQ ID NO: 245 - protein, 8 aa, Artificial Sequence
  Description of Artificial Sequence: Synthetic peptide
GGPFSSYA

SEQ ID NO: 246 - protein, 8 aa, Artificial Sequence
  Description of Artificial Sequence: Synthetic peptide
GGIFSSYA

SEQ ID NO: 247 - protein, 8 aa, Artificial Sequence
  Description of Artificial Sequence: Synthetic peptide
IITIFGTA

SEQ ID NO: 248 - protein, 8 aa, Artificial Sequence
  Description of Artificial Sequence: Synthetic peptide
ISPIFGTA

SEQ ID NO: 249 - protein, 8 aa, Artificial Sequence
  Description of Artificial Sequence: Synthetic peptide
ISAIFGTA

SEQ ID NO: 250 - protein, 8 aa, Artificial Sequence
  Description of Artificial Sequence: Synthetic peptide
ITPIFGTA

SEQ ID NO: 251 - protein, 8 aa, Artificial Sequence
  Description of Artificial Sequence: Synthetic peptide
ISPIFGTA

SEQ ID NO: 252 - protein, 8 aa, Artificial Sequence
  Description of Artificial Sequence: Synthetic peptide
ISPIFGTA

SEQ ID NO: 253 - protein, 8 aa, Artificial Sequence
  Description of Artificial Sequence: Synthetic peptide
IITIFGTA

SEQ ID NO: 254 - protein, 8 aa, Artificial Sequence
  Description of Artificial Sequence: Synthetic peptide
IIPIFGTA

SEQ ID NO: 255 - protein, 8 aa, Artificial Sequence
  Description of Artificial Sequence: Synthetic peptide
ISPLFGTA

SEQ ID NO: 256 - protein, 8 aa, Artificial Sequence
  Description of Artificial Sequence: Synthetic peptide
ISPMFGTA

SEQ ID NO: 257 - protein, 8 aa, Artificial Sequence
  Description of Artificial Sequence: Synthetic peptide
IIPIFGTA

SEQ ID NO: 258 - protein, 8 aa, Artificial Sequence
  Description of Artificial Sequence: Synthetic peptide
ISPVFGTA

SEQ ID NO: 259 - protein, 8 aa, Artificial Sequence
  Description of Artificial Sequence: Synthetic peptide
IVPLFGTA

SEQ ID NO: 260 - protein, 8 aa, Artificial Sequence
  Description of Artificial Sequence: Synthetic peptide
IIPIFGTA

SEQ ID NO: 261 - protein, 8 aa, Artificial Sequence
  Description of Artificial Sequence: Synthetic peptide
ISPIFGTA

SEQ ID NO: 262 - protein, 8 aa, Artificial Sequence
  Description of Artificial Sequence: Synthetic peptide
ISAIFGTA

SEQ ID NO: 263 - protein, 8 aa, Artificial Sequence
  Description of Artificial Sequence: Synthetic peptide
IIPMFGTA

SEQ ID NO: 264 - protein, 8 aa, Artificial Sequence
  Description of Artificial Sequence: Synthetic peptide
INPIFGTA

SEQ ID NO: 265 - protein, 8 aa, Artificial Sequence
  Description of Artificial Sequence: Synthetic peptide
ISPMFGTA

SEQ ID NO: 266 - protein, 8 aa, Artificial Sequence
  Description of Artificial Sequence: Synthetic peptide
ITPLFGTA

SEQ ID NO: 267 - protein, 8 aa, Artificial Sequence
  Description of Artificial Sequence: Synthetic peptide
IMPIFGTA

SEQ ID NO: 268 - protein, 8 aa, Artificial Sequence
  Description of Artificial Sequence: Synthetic peptide
ISPMFGTA

SEQ ID NO: 269 - protein, 8 aa, Artificial Sequence
  Description of Artificial Sequence: Synthetic peptide
IIPIFGTA

SEQ ID NO: 270 - protein, 8 aa, Artificial Sequence
  Description of Artificial Sequence: Synthetic peptide
ITPIFGTA

SEQ ID NO: 271 - protein, 8 aa, Artificial Sequence
  Description of Artificial Sequence: Synthetic peptide
ISPMFGTA

SEQ ID NO: 272 - protein, 8 aa, Artificial Sequence
  Description of Artificial Sequence: Synthetic peptide
ISGIFGTA

SEQ ID NO: 273 - protein, 8 aa, Artificial Sequence
  Description of Artificial Sequence: Synthetic peptide
ISPIFGTA

SEQ ID NO: 274 - protein, 8 aa, Artificial Sequence
  Description of Artificial Sequence: Synthetic peptide
ISPMFGTA

SEQ ID NO: 275 - protein, 8 aa, Artificial Sequence
  Description of Artificial Sequence: Synthetic peptide
ISPMFGTA

SEQ ID NO: 276 - protein, 8 aa, Artificial Sequence
  Description of Artificial Sequence: Synthetic peptide
ISPIFGTA

SEQ ID NO: 277 - protein, 10 aa, Artificial Sequence
  Description of Artificial Sequence: Synthetic peptide
ARGATGFYDV

SEQ ID NO: 278 - protein, 16 aa, Artificial Sequence
  Description of Artificial Sequence: Synthetic peptide
ARGREYYASNGDSFDV

SEQ ID NO: 279 - protein, 20 aa, Artificial Sequence
  Description of Artificial Sequence: Synthetic peptide
ARDLSRDSLNLPGSSPGYDL

SEQ ID NO: 280 - protein, 16 aa, Artificial Sequence
  Description of Artificial Sequence: Synthetic peptide
ARGSGYYVAASGAFDV

SEQ ID NO: 281 - protein, 16 aa, Artificial Sequence
  Description of Artificial Sequence: Synthetic peptide
ARSRGYAPGTSFHYDV

SEQ ID NO: 282 - protein, 14 aa, Artificial Sequence
  Description of Artificial Sequence: Synthetic peptide
ARDQGGTRGNYFDV

SEQ ID NO: 283 - protein, 10 aa, Artificial Sequence
  Description of Artificial Sequence: Synthetic peptide
ARGGGGRFDV

SEQ ID NO: 284 - protein, 10 aa, Artificial Sequence
  Description of Artificial Sequence: Synthetic peptide
ARGGVYSFDV

SEQ ID NO: 285 - protein, 18 aa, Artificial Sequence
  Description of Artificial Sequence: Synthetic peptide
ARGLGTYSPSLYPRGMDV

SEQ ID NO: 286 - protein, 15 aa, Artificial Sequence
  Description of Artificial Sequence: Synthetic peptide
ARGRAYLSVRGSFDV

SEQ ID NO: 287 - protein, 10 aa, Artificial Sequence
  Description of Artificial Sequence: Synthetic peptide
ARGGSGSFDV

SEQ ID NO: 288 - protein, 18 aa, Artificial Sequence
  Description of Artificial Sequence: Synthetic peptide
ARSRGYTVSSLAGRYFDQ

SEQ ID NO: 289 - protein, 10 aa, Artificial Sequence
  Description of Artificial Sequence: Synthetic peptide
ARGLGLYFDV

SEQ ID NO: 290 - protein, 15 aa, Artificial Sequence
  Description of Artificial Sequence: Synthetic peptide
ARVRGGYGPYGDFDV

SEQ ID NO: 291 - protein, 16 aa, Artificial Sequence
  Description of Artificial Sequence: Synthetic peptide
ARGRSYIVSVSPGFDV

SEQ ID NO: 292 - protein, 16 aa, Artificial Sequence
  Description of Artificial Sequence: Synthetic peptide
ARDSGIASGYTAYMDY

SEQ ID NO: 293 - protein, 10 aa, Artificial Sequence
  Description of Artificial Sequence: Synthetic peptide
ARGAGSTFDV

SEQ ID NO: 294 - protein, 14 aa, Artificial Sequence
  Description of Artificial Sequence: Synthetic peptide
ARGESAYYSRNYDV

SEQ ID NO: 295 - protein, 16 aa, Artificial Sequence
  Description of Artificial Sequence: Synthetic peptide
ARGGGYYPAGVGRYDV

SEQ ID NO: 296 - protein, 14 aa, Artificial Sequence
  Description of Artificial Sequence: Synthetic peptide
ARGPTLYSPPVFDV

SEQ ID NO: 297 - protein, 16 aa, Artificial Sequence
  Description of Artificial Sequence: Synthetic peptide
ARGAGVSAGPSWPFDV

SEQ ID NO: 298 - protein, 16 aa, Artificial Sequence
  Description of Artificial Sequence: Synthetic peptide
ARSRGYNVAASFGFDV

SEQ ID NO: 299 - protein, 14 aa, Artificial Sequence
  Description of Artificial Sequence: Synthetic peptide
ARGTDYSGYRGFDV

SEQ ID NO: 300 - protein, 9 aa, Artificial Sequence
  Description of Artificial Sequence: Synthetic peptide
ARGGGVFDV

SEQ ID NO: 301 - protein, 15 aa, Artificial Sequence
  Description of Artificial Sequence: Synthetic peptide
AREGGYSPGGVDFDY

SEQ ID NO: 302 - protein, 14 aa, Artificial Sequence
  Description of Artificial Sequence: Synthetic peptide
ARSPAYYFGPNMDV

SEQ ID NO: 303 - protein, 18 aa, Artificial Sequence
  Description of Artificial Sequence: Synthetic peptide
ARGPGYHPAGASGQFFDL

SEQ ID NO: 304 - protein, 16 aa, Artificial Sequence
  Description of Artificial Sequence: Synthetic peptide
ARGRGYAPDALTNFDV

SEQ ID NO: 305 - protein, 18 aa, Artificial Sequence
  Description of Artificial Sequence: Synthetic peptide
ARGYSYYPGGGGGRNFDY

SEQ ID NO: 306 - protein, 15 aa, Artificial Sequence
  Description of Artificial Sequence: Synthetic peptide
ARSGGYYDYGVGYDQ

SEQ ID NO: 307 - protein, 8 aa, Artificial Sequence
  Description of Artificial Sequence: Synthetic peptide
SSNIGSNT

SEQ ID NO: 308 - protein, 6 aa, Artificial Sequence
  Description of Artificial Sequence: Synthetic peptide
NIATKS

SEQ ID NO: 309 - protein, 6 aa, Artificial Sequence
  Description of Artificial Sequence: Synthetic peptide
NIATKS

SEQ ID NO: 310 - protein, 8 aa, Artificial Sequence
  Description of Artificial Sequence: Synthetic peptide
INNVGDQG

SEQ ID NO: 311 - protein, 6 aa, Artificial Sequence
  Description of Artificial Sequence: Synthetic peptide
NIGSKS

SEQ ID NO: 312 - protein, 8 aa, Artificial Sequence
  Description of Artificial Sequence: Synthetic peptide
SNNVGNQG

SEQ ID NO: 313 - protein, 8 aa, Artificial Sequence
  Description of Artificial Sequence: Synthetic peptide
TSNIGNNA

SEQ ID NO: 314 - protein, 8 aa, Artificial Sequence
  Description of Artificial Sequence: Synthetic peptide
GSNVGSNV

SEQ ID NO: 315 - protein, 8 aa, Artificial Sequence
  Description of Artificial Sequence: Synthetic peptide
SSNIGRND

SEQ ID NO: 316 - protein, 8 aa, Artificial Sequence
  Description of Artificial Sequence: Synthetic peptide
SSNIGSNT

SEQ ID NO: 317 - protein, 8 aa, Artificial Sequence
  Description of Artificial Sequence: Synthetic peptide
SSNLGSNY

SEQ ID NO: 318 - protein, 7 aa, Artificial Sequence
  Description of Artificial Sequence: Synthetic peptide
ESLCSTC

SEQ ID NO: 319 - protein, 9 aa, Artificial Sequence
  Description of Artificial Sequence: Synthetic peptide
TGAVTSGYY

SEQ ID NO: 320 - protein, 8 aa, Artificial Sequence
  Description of Artificial Sequence: Synthetic peptide
SSNIGSHS

SEQ ID NO: 321 - protein, 9 aa, Artificial Sequence
  Description of Artificial Sequence: Synthetic peptide
SSDVGGYNY

SEQ ID NO: 322 - protein, 6 aa, Artificial Sequence
  Description of Artificial Sequence: Synthetic peptide
SLRTSY

SEQ ID NO: 323 - protein, 8 aa, Artificial Sequence
  Description of Artificial Sequence: Synthetic peptide
SSNIGSNT

SEQ ID NO: 324 - protein, 8 aa, Artificial Sequence
  Description of Artificial Sequence: Synthetic peptide
SSNVGNQG

SEQ ID NO: 325 - protein, 12 aa, Artificial Sequence
  Description of Artificial Sequence: Synthetic peptide
QNVLYSSNNKNN

SEQ ID NO: 326 - protein, 9 aa, Artificial Sequence
  Description of Artificial Sequence: Synthetic peptide
SGSVSTTNY

SEQ ID NO: 327 - protein, 8 aa, Artificial Sequence
  Description of Artificial Sequence: Synthetic peptide
SNNVGKQG

SEQ ID NO: 328 - protein, 6 aa, Artificial Sequence
  Description of Artificial Sequence: Synthetic peptide
QYIDRS

SEQ ID NO: 329 - protein, 9 aa, Artificial Sequence
  Description of Artificial Sequence: Synthetic peptide
SGSVSSFNY

SEQ ID NO: 330 - protein, 8 aa, Artificial Sequence
  Description of Artificial Sequence: Synthetic peptide
SSNIGNNA

SEQ ID NO: 331 - protein, 8 aa, Artificial Sequence
  Description of Artificial Sequence: Synthetic peptide
SGSIASTY

SEQ ID NO: 332 - protein, 9 aa, Artificial Sequence
  Description of Artificial Sequence: Synthetic peptide
SSNIGAGYD

SEQ ID NO: 333 - protein, 8 aa, Artificial Sequence
  Description of Artificial Sequence: Synthetic peptide
SNNVGNQG

SEQ ID NO: 334 - protein, 12 aa, Artificial Sequence
  Description of Artificial Sequence: Synthetic peptide
RSLFDSSDNKNY

SEQ ID NO: 335 - protein, 8 aa, Artificial Sequence
  Description of Artificial Sequence: Synthetic peptide
SSNIGSNT

SEQ ID NO: 336 - protein, 8 aa, Artificial Sequence
  Description of Artificial Sequence: Synthetic peptide
RSNIGSNT

SEQ ID NO: 337 - protein, 3 aa, Artificial Sequence
  Description of Artificial Sequence: Synthetic peptide
SNN

SEQ ID NO: 338 - protein, 3 aa, Artificial Sequence
  Description of Artificial Sequence: Synthetic peptide
HDS

SEQ ID NO: 339 - protein, 3 aa, Artificial Sequence
  Description of Artificial Sequence: Synthetic peptide
RNS

SEQ ID NO: 340 - protein, 3 aa, Artificial Sequence
  Description of Artificial Sequence: Synthetic peptide
GAS

SEQ ID NO: 341 - protein, 3 aa, Artificial Sequence
  Description of Artificial Sequence: Synthetic peptide
YDS

SEQ ID NO: 342 - protein, 3 aa, Artificial Sequence
  Description of Artificial Sequence: Synthetic peptide
RNN

SEQ ID NO: 343 - protein, 3 aa, Artificial Sequence
  Description of Artificial Sequence: Synthetic peptide
SLN

SEQ ID NO: 344 - protein, 3 aa, Artificial Sequence
  Description of Artificial Sequence: Synthetic peptide
RNN

SEQ ID NO: 345 - protein, 3 aa, Artificial Sequence
  Description of Artificial Sequence: Synthetic peptide
GRD

SEQ ID NO: 346 - protein, 3 aa, Artificial Sequence
  Description of Artificial Sequence: Synthetic peptide
SNN

SEQ ID NO: 347 - protein, 3 aa, Artificial Sequence
  Description of Artificial Sequence: Synthetic peptide
RNS

SEQ ID NO: 348 - protein, 3 aa, Artificial Sequence
  Description of Artificial Sequence: Synthetic peptide
GAT

SEQ ID NO: 349 - protein, 3 aa, Artificial Sequence
  Description of Artificial Sequence: Synthetic peptide
STS

SEQ ID NO: 350 - protein, 3 aa, Artificial Sequence
  Description of Artificial Sequence: Synthetic peptide
GNS

SEQ ID NO: 351 - protein, 3 aa, Artificial Sequence
  Description of Artificial Sequence: Synthetic peptide
EVS

SEQ ID NO: 352 - protein, 3 aa, Artificial Sequence
  Description of Artificial Sequence: Synthetic peptide
QST

SEQ ID NO: 353 - protein, 3 aa, Artificial Sequence
  Description of Artificial Sequence: Synthetic peptide
SNN

SEQ ID NO: 354 - protein, 3 aa, Artificial Sequence
  Description of Artificial Sequence: Synthetic peptide
RND

SEQ ID NO: 355 - protein, 3 aa, Artificial Sequence
  Description of Artificial Sequence: Synthetic peptide
WAS

SEQ ID NO: 356 - protein, 3 aa, Artificial Sequence
  Description of Artificial Sequence: Synthetic peptide
NTN

SEQ ID NO: 357 - protein, 3 aa, Artificial Sequence
  Description of Artificial Sequence: Synthetic peptide
RNN

SEQ ID NO: 358 - protein, 3 aa, Artificial Sequence
  Description of Artificial Sequence: Synthetic peptide
YAS

SEQ ID NO: 359 - protein, 3 aa, Artificial Sequence
  Description of Artificial Sequence: Synthetic peptide
NTN

SEQ ID NO: 360 - protein, 3 aa, Artificial Sequence
  Description of Artificial Sequence: Synthetic peptide
YDD

SEQ ID NO: 361 - protein, 3 aa, Artificial Sequence
  Description of Artificial Sequence: Synthetic peptide
EDH

SEQ ID NO: 362 - protein, 3 aa, Artificial Sequence
  Description of Artificial Sequence: Synthetic peptide
DNS

SEQ ID NO: 363 - protein, 3 aa, Artificial Sequence
  Description of Artificial Sequence: Synthetic peptide
RNN

SEQ ID NO: 364 - protein, 3 aa, Artificial Sequence
  Description of Artificial Sequence: Synthetic peptide
WAS

SEQ ID NO: 365 - protein, 3 aa, Artificial Sequence
  Description of Artificial Sequence: Synthetic peptide
SNN

SEQ ID NO: 366 - protein, 3 aa, Artificial Sequence
  Description of Artificial Sequence: Synthetic peptide
SNN

SEQ ID NO: 367 - protein, 11 aa, Artificial Sequence
  Description of Artificial Sequence: Synthetic peptide
AAWDDSLNGPV

SEQ ID NO: 368 - protein, 12 aa, Artificial Sequence
  Description of Artificial Sequence: Synthetic peptide
AAWDDSLSGPWV

SEQ ID NO: 369 - protein, 11 aa, Artificial Sequence
  Description of Artificial Sequence: Synthetic peptide
SAWDSSLSDWV

SEQ ID NO: 370 - protein, 9 aa, Artificial Sequence
  Description of Artificial Sequence: Synthetic peptide
QQYSSSPYT

SEQ ID NO: 371 - protein, 11 aa, Artificial Sequence
  Description of Artificial Sequence: Synthetic peptide
QLWDHTNSHVV

SEQ ID NO: 372 - protein, 11 aa, Artificial Sequence
  Description of Artificial Sequence: Synthetic peptide
SAWDNTVSGWV

SEQ ID NO: 373 - protein, 11 aa, Artificial Sequence
  Description of Artificial Sequence: Synthetic peptide
EAWDDSLSGPV

SEQ ID NO: 374 - protein, 11 aa, Artificial Sequence
  Description of Artificial Sequence: Synthetic peptide
AAWDDRLNGFV

SEQ ID NO: 375 - protein, 11 aa, Artificial Sequence
  Description of Artificial Sequence: Synthetic peptide
AAWDASLMIYV

SEQ ID NO: 376 - protein, 11 aa, Artificial Sequence
  Description of Artificial Sequence: Synthetic peptide
AAWDDSLNGYV

SEQ ID NO: 377 - protein, 11 aa, Artificial Sequence
  Description of Artificial Sequence: Synthetic peptide
AAWDDSLNGVV

SEQ ID NO: 378 - protein, 9 aa, Artificial Sequence
  Description of Artificial Sequence: Synthetic peptide
QQYGSSPQT

SEQ ID NO: 379 - protein, 9 aa, Artificial Sequence
  Description of Artificial Sequence: Synthetic peptide
LLYYGGPWV

SEQ ID NO: 380 - protein, 11 aa, Artificial Sequence
  Description of Artificial Sequence: Synthetic peptide
AAWDDGLSGWV

SEQ ID NO: 381 - protein, 11 aa, Artificial Sequence
  Description of Artificial Sequence: Synthetic peptide
ASWDDSLNAYV

SEQ ID NO: 382 - protein, 11 aa, Artificial Sequence
  Description of Artificial Sequence: Synthetic peptide
NSRGSGGNPYV

SEQ ID NO: 383 - protein, 11 aa, Artificial Sequence
  Description of Artificial Sequence: Synthetic peptide
AAWDDSLNGRV

SEQ ID NO: 384 - protein, 11 aa, Artificial Sequence
  Description of Artificial Sequence: Synthetic peptide
SAWDNSLSAWV

SEQ ID NO: 385 - protein, 9 aa, Artificial Sequence
  Description of Artificial Sequence: Synthetic peptide
QQYYGKPFT

SEQ ID NO: 386 - protein, 10 aa, Artificial Sequence
  Description of Artificial Sequence: Synthetic peptide
VLYMGRGIYV

SEQ ID NO: 387 - protein, 11 aa, Artificial Sequence
  Description of Artificial Sequence: Synthetic peptide
SAWDSSLSVWV

SEQ ID NO: 388 - protein, 9 aa, Artificial Sequence
  Description of Artificial Sequence: Synthetic peptide
HQTSSLPWT

SEQ ID NO: 389 - protein, 10 aa, Artificial Sequence
  Description of Artificial Sequence: Synthetic peptide
ALYVGGGISV

SEQ ID NO: 390 - protein, 11 aa, Artificial Sequence
  Description of Artificial Sequence: Synthetic peptide
AAWDDSLSGPV

SEQ ID NO: 391 - protein, 9 aa, Artificial Sequence
  Description of Artificial Sequence: Synthetic peptide
QSFDASTLV

SEQ ID NO: 392 - protein, 11 aa, Artificial Sequence
  Description of Artificial Sequence: Synthetic peptide
QSYDSSLSVVV

SEQ ID NO: 393 - protein, 11 aa, Artificial Sequence
  Description of Artificial Sequence: Synthetic peptide
SAWDSSLSAWV

SEQ ID NO: 394 - protein, 11 aa, Artificial Sequence
  Description of Artificial Sequence: Synthetic peptide
QQYFSSPPIFT

SEQ ID NO: 395 - protein, 11 aa, Artificial Sequence
  Description of Artificial Sequence: Synthetic peptide
AAWDDSLKGRV

SEQ ID NO: 396 - protein, 8 aa, Artificial Sequence
  Description of Artificial Sequence: Synthetic peptide
QSYDSSVV

SEQ ID NO: 397 - DNA, 372 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtggcccattcagctcatacgccattagctgggtgcgacaggctcctggtcagggcctcgaatggatgggcggcattagcccaatgtttggcactgcaaattatgcccagaaatttcagggtagagtcacaattaccgcagacaagagcacctcaaccgcctacatggaactgagtagcctgcgttccgaagatacagctgtgtattactgtgcgcgcgacgacggttacgctcctagtggtggtctgcgtgagtttgacgtttggggccaggggaccttagtcactgtgtctagc

SEQ ID NO: 398 - DNA, 340 bp, Artificial Sequence
  Description of Artificial Sequence: Synthetic polynucleotide
gacatccagatgacccagtctccagactccctggctgtgtctctgggcgagagggccaccatcaactgcaagtccagccggagtgttttatacagctccaacaacaagaactacttagcttggtaccaacaaaaaccgggacagcctcctaagttgctcatttattgggcttctacccgggaatccggggtccctgaccgattcagtggcagcgggtctgggacagatttcactctcaccatcagcagcctgcaggctgaagatgtggcggtttattactgtcagcaatattatagtggttcctggacattcggccaagggaccaaggtggaaatcaaac

SEQ ID NO: 399 - DNA, 363 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggaggcatctttagctcatacgccattagctgggtgcgacaggctcctggtcagggcctcgaatggatgggcggcattagccctatctttggcactgcaaattatgcccagaaatttcagggtagagtcacaattaccgcagataaaagcacgaataccgcctacatggaactgagtagcctgcgttccgaagatacagctgtgtattactgtgcgcgcggtcgtggtgcttacatgggtcctagtatggatgtgtggggccaggggaccttagtcactgtgtctagc

SEQ ID NO: 400 - DNA, 325 bp, Artificial Sequence
  Description of Artificial Sequence: Synthetic polynucleotide
cagcctgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaggccggggatgaggccgactactactgtcaggtgtgggataggagtagtgatcatgtggtgttcggcggagggaccaagctgaccgtcctag

SEQ ID NO: 401 - DNA, 363 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggaggtaccttcagctcatacgccattagctgggtgcgacaggctcctggtcagggcctcgaatggatgggcggcatcagcccaatctttggcactgcaaattatgcccagaaatttcagggtagagtcacaattaccgcagataaaagcacgtcaactgtgtatatggaactgagtagcctgcgttccgaagatacagctgtgtattactgtgcgcgcggtgctcgttactacgctggtggttacttcgatgtgtggggccaggggaccttagtcactgtgtctagc

SEQ ID NO: 402 - DNA, 325 bp, Artificial Sequence
  Description of Artificial Sequence: Synthetic polynucleotide
gaaattgtgctgactcagtctccaggcaccctgtctttgtctccaggggaaagagccaccctctcctgcagggccagtcagactgttagcaactacttagcctggtatcagcagagacctggccaggctcccaggctcctcatctacgctgcatccacgcgggccactggtgtcccagccaggttcagtggcagcgggtctgggacagagttcactctcaccatcagcagcctgcaatctgaagattttgcaatttattactgtcaacagtatgataacttgcctccggtcactttcggccctgggaccacagtggatatcaaac

SEQ ID NO: 403 - DNA, 375 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtgttacctttagctcatacgccattagctgggtgcgacaggctcctggtcagggcctcgaatggatgggcggcatcagcccaatcttcggtactgcaaattatgcccagaaatttcagggtagagtcacaattaccgcagatcagagtaccaacactgtctacatggaactgagtagcctgcgttccgaagatacagctgtgtattactgtgcgcgcgacagtggtaattacgacggttacggtcctggtagtcgtttcgacgtgtggggccaggggaccttagtcactgtgtctagc

SEQ ID NO: 404 - DNA, 331 bp, Artificial Sequence
  Description of Artificial Sequence: Synthetic polynucleotide
cagcctgggctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattatttctgttcagcttgggatgacagcctgggtggcgaggtcttcggaactgggaccaaggtcaacgtcctag

SEQ ID NO: 405 - DNA, 363 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggagtgacctttagttcttacgccattagctgggtgcgacaggctcctggtcagggcctcgaatggatgggcggcattatgcctatgttcggcactgcaaattatgcccagaaatttcagggtagagtcacaattaccgcagataagagtacgagcactgcctatatggaactgagtagcctgcgttccgaagatacagctgtgtattactgtgcgcgcgagcgtggtagttggagtttcggttactttgatgtgtggggccaggggaccttagtcactgtgtctagc

SEQ ID NO: 406 - DNA, 325 bp, Artificial Sequence
  Description of Artificial Sequence: Synthetic polynucleotide
ctgcctgtgctgactcagccaccctcgatgtcagcggccccaggacagacggccaggattacctgtgggggagaccacattggaagtaaaagtgtgcactggtaccagcggaagccgggccaggcccctgtgctggtcatctattctgacaccgaccggccctcagggatccctgagcggttctctggctccaactctgggaacacggccaccctgaccatcagcagggtcgaagccggggatgaggccgactatttctgtcaggtgtgggatagtagtaatgatcatccggtgttcggcggaggcaccaagctgaccgtcctag

SEQ ID NO: 407 - DNA, 363 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggagtgacctttagctcttacgccattagctgggtgcgacaggctcctggtcagggcctcgaatggatgggcggcatcagccctctgtttggcactgcaaattatgcccagaaatttcagggtagagtcacaattaccgcagacaaaagtacgagcaccgtgtatatggaactgagtagcctgcgttccgaagatacagctgtgtattactgtgcgcgcagtcgtacatacgctgacggtcgtacattcgacgtgtggggccaggggaccttagtcactgtgtctagc

SEQ ID NO: 408 - DNA, 331 bp, Artificial Sequence
  Description of Artificial Sequence: Synthetic polynucleotide
cagtctgtgctgactcagccaccctccgcgtccgggtctcctggacagtcggtcaccatctcctgcactggaaccagtagtgacgttggtggttataaccatgtctcctggtaccaacagcacccaggcaaagcccccaaagtcctgatttatgacgtcagtaagcggccctcaggggtcccagatcgcttctctggctccaagtctggcaacacggcctccctgaccgtctctgggctccaggctgaggatgaggctgattattactgcacctcatatgcaggcagcaacagtttggtcttcggaactgggaccgaggtcaccgtcctag

SEQ ID NO: 409 - DNA, 372 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtggcactttcagttcatacgccattagctgggtgcgacaggctcctggtcagggcctcgaatggatgggcggcatcagcccaatctttggtactgcaaattatgcccagaaatttcagggtagagtcacaattaccgcagacaagagcacgagcactgcctacatggaactgagtagcctgcgttccgaagatacagctgtgtattactgtgcgcgcgagctgggttacctggctggtagtcctagtcctggtttcgattactggggccaggggaccttagtcactgtgtctagc

SEQ ID NO: 410 - DNA, 328 bp, Artificial Sequence
  Description of Artificial Sequence: Synthetic polynucleotide
cagtctgtgctgactcagccaccctccgcgtccgggtctcctggacagtcagtcaccatctcctgcactggaaccagcagtgacgttggtggttataactatgtctcctggtaccaacagcacccaggcaaagcccccaaactcatcatttatgaggtcactaagcggccctcaggggtccctgatcgcttctctggctccaagtctggcaacacggcctccctgaccgtcgctgggctccaggctgaggatgaggctgattattactgcagctcgtatgcaggcggcaagtgggtcttcggaactgggaccaaggtcaccgtcctag

SEQ ID NO: 411 - DNA, 363 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggaggcacttttagctcttacgccattagctgggtgcgacaggctcctggtcagggcctcgaatggatgggcggcattagcccaatcttcggcactgcaaattatgcccagaaatttcagggtagagtcacaattaccgcagacaccagcacctcaaccgcctacatggaactgagtagcctgcgttccgaagatacagctgtgtattactgtgcgcgcagtcgtcgttactgggctgacggtggtttcgattattggggccaggggaccttagtcactgtgtctagc

SEQ ID NO: 412 - DNA, 331 bp, Artificial Sequence
  Description of Artificial Sequence: Synthetic polynucleotide
ctgcctgtgctgactcagccaccctcagcgtctgggacccccgggcagagggtcaccatctcttgttctggaagcagctccaacatgggaagaaataccgtcaactggtaccggcacctcccagggacggcccccgaactcctcatctatgataatgatgagcgtccctcaggggtccctgaccgattctctggctccaagtctggcacctcagcctccctggccatcagtgggctccagtctgaagatgagggtcattattactgtgctgcgtgggatgacagcctgaatggtccggtgttcggcggagggaccaagctgaccgtcctgg

SEQ ID NO: 413 - DNA, 366 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggaggtacttttagttcttacgccattagctgggtgcgacaggctcctggtcagggcctcgaatggatgggcggcattagccctatgttcggtactgcaaattatgcccagaaatttcagggtagagtcacaattaccgcagacaaaagtaccagcactgcctacatggaactgagtagcctgcgttccgaagatacagctgtgtattactgtgcgcgcgagggtggttacagtcctggtggtgttgacttcgactactggggccaggggaccttagtcactgtgtctagc

SEQ ID NO: 414 - DNA, 331 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccagcacctatgtgcagtggtaccggcagcgcccgggcagtgcccccaccactgtgatctatgaggatcatcagagaccctctggggtccctgatcggttctccggctccctcgacagctcctccaactctgcctccctcaccatctctggactgaggactgaggacgcggcaacctactactgtcagtcttttgatgccagcactctggtgttcggcggcgggaccaagctgaccgtcctcg

SEQ ID NO: 415 - DNA, 363 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtgttacttttagttcttacgccattagctgggtgcgacaggctcctggtcagggcctcgaatggatgggcggcatcagcccaatctttggtactgcaaattatgcccagaaatttcagggtagagtcacaattaccgcagacgaaagtacgaatactgtgtatatggaactgagtagcctgcgttccgaagatacagctgtgtattactgtgcgcgcggtacaacatacagtacagctcgttacttcgacgtttggggccaggggaccttagtcactgtgtctagc

SEQ ID NO: 416 - DNA, 337 bp, Artificial Sequence
  Description of Artificial Sequence: Synthetic polynucleotide
aattttatgctgactcagccccactctgtgtcggagtctccggggaagacggtaaccatctcctgcacccgcagaagtggcagcattgccagcaactatgtgcagtggtaccagcagcgcccgggcagtgcccccaccactgtgatctatgaggataaccaaagaccctctggggtccctgatcgcttctctggctccatcgacaggtcctccaactctgcctccctcaccatctctggactgaagactgaggacgaggctgactactactgtcagtcttatgacagcgacaatcatgaagtgatattcggcggagggaccaagctgaccgtcctag

SEQ ID NO: 417 - DNA, 363 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggagtgacttttcgttcatacgccattagctgggtgcgacaggctcctggtcagggcctcgaatggatgggcggcatcagcggtatctttggtactgcaaattatgcccagaaatttcagggtagagtcacaattaccgcagatgagagcacgtcaaccgcatatatggaactgagtagcctgcgttccgaagatacagctgtgtattactgtgcgcgcagtcctgcttactacttcggtcctaatatggacgtgtggggccaggggaccttagtcactgtgtctagc

SEQ ID NO: 418 - DNA, 334 bp, Artificial Sequence
  Description of Artificial Sequence: Synthetic polynucleotide
cagtctgtgctgactcagccaccctcagtgtctggggccccagggcagagggtcaccatctcctgcactgggagcagctccaacatcggggcaggttatgatgtacactggtaccagcaacttccaggaacagtccccaaactcatcatctatgataatagcaatcggccctcaggggtccctgcccgattctctggctccaagtctggcacctcagcctccctggccatcagtgggctccagtctgaggatgaggccgcatattattgccagtcgtatgacagcagcctgagtgttgtggtattcggcggtgggaccaagctgtccgtcctag

SEQ ID NO: 419 - DNA, 369 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggaggcacttttagttcttacgccattagctgggtgcgacaggctcctggtcagggcctcgaatggatgggcggcatcagccctatgtttggtactgcaaattatgcccagaaatttcagggtagagtcacaattaccgcagacaaaagtacgagcactgcctacatggaactgagtagcctgcgttccgaagatacagctgtgtattactgtgcgcgcagtagtcgttacgctcctagtgacagtacaaattttgatcaatggggccaggggaccttagtcactgtgtctagc

SEQ ID NO: 420 - DNA, 334 bp, Artificial Sequence
  Description of Artificial Sequence: Synthetic polynucleotide
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgataccagcaatcggaaggttttcggcggagggaccaagctgaccgtcctag

SEQ ID NO: 421 - DNA, 363 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtggcccatttagttcatacgccattagctgggtgcgacaggctcctggtcagggcctcgaatggatgggcggcattagcggtatctttggcactgcaaattatgcccagaaatttcagggtagagtcacaattaccgcagatgagagcacgtcaaccgcatatatggaactgagtagcctgcgttccgaagatacagctgtgtattactgtgcgcgcggtgaccgtttctacgttggtgagcgtttcgatgtgtggggccaggggaccttagtcactgtgtctagc

SEQ ID NO: 422 - DNA, 328 bp, Artificial Sequence
  Description of Artificial Sequence: Synthetic polynucleotide
cagtctgtgctgactcagccaccctcggtgtcagtggccccaggacagacggccagaattacctgtgggggaaatgacattggaagtaaaagtgtccactggtaccagcagaagccaggccaggcccctgtgctggtcgtctatgatgatatcgaccggccctcagggatccctgagcgattctctggctccaactatggggacacggccaccctgaccatcagctgggtcgaggccggggatgaggccgactattactgtcaggtgtgggatactaatagtgatcccgtctttgtcttcggaagtgggaccaaggtcaccgtccttg

SEQ ID NO: 423 - DNA, 375 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtggcaccttcagctcttacgccattagctgggtgcgacaggctcctggtcagggcctcgaatggatgggcggcattagcccaatcttcggtactgcaaattatgcccagaaatttcagggtagagtcacaattaccgcagaccagagcacgagcactgcctacatggaactgagtagcctgcgttccgaagatacagctgtgtattactgtgcgcgcggtggtggtgttggtcgtatctggatcgctggttacggtttcgatcagtggggccaggggaccttagtcactgtgtctagc

SEQ ID NO: 424 - DNA, 331 bp, Artificial Sequence
  Description of Artificial Sequence: Synthetic polynucleotide
cagactgtggtgactcaggagccatcgttctcagtgtcccctggagggacagttaccctcacttgtggcttgagctctggctcagtctccactagtaactaccccagctggtaccagcagaccccaggccagcctccacgcacgctcatctacagcacaaacactcgctcttctggggtccctgatcgcttctctggctccatccttgggaacaaagctgccctcaccatcacgggggcccaggcagatgatgaatctgattattactgtgtcctatatatgggtagtggcatttcgatgttcggcggagggaccaagttgaccgtcctag

SEQ ID NO: 425 - DNA, 375 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtggtacttttagttcatacgccattagctgggtgcgacaggctcctggtcagggcctcgaatggatgggcggcattagcccaatctttggtactgcaaattatgcccagaaatttcagggtagagtcacaattaccgcagacgaaagcaccagcactgtgtacatggaactgagtagcctgcgttccgaagatacagctgtgtattactgtgcgcgcggtcctggttaccaccctgctggtgctagtggtcaattctttgatctttggggccaggggaccttagtcactgtgtctagc

SEQ ID NO: 426 - DNA, 331 bp, Artificial Sequence
  Description of Artificial Sequence: Synthetic polynucleotide
tcctatgagctgactcagccaccctcggtgtccaaggacttgagacagaccgccacactcacctgcactgggaacagcaacaatgttggcaaccaaggagcagcttggctgcagcagcaccagggccaccctcccaaactcctatcctacaggaataaccaccggccctcagggatctcagacagatcatctgcatccaggtcaggagacacagcctccctgaccattactggactccagcctgaggacgaggctgactattactgctcagcatgggacagcagcctcagtgcttgggtgttcggcggagggaccaagctgaccgtcctag

SEQ ID NO: 427 - DNA, 369 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtgtgaccttcagctcatacgccattagctgggtgcgacaggctcctggtcagggcctcgaatggatgggcggcattagccctatgtttggtactgcaaattatgcccagaaatttcagggtagagtcacaattaccgcagatgaaagcaccaacaccgcctatatggaactgagtagcctgcgttccgaagatacagctgtgtattactgtgcgcgcggtcgtggttacgctcctgacgctctgacaaattttgacgtttggggccaggggaccttagtcactgtgtctagc

SEQ ID NO: 428 - DNA, 346 bp, Artificial Sequence
  Description of Artificial Sequence: Synthetic polynucleotide
gaaattgtgctgactcagtctccagactccctggctatgtctctgggcgagagggccaccgtcaactgcaagtccagccggagtcttttcgacagctccgacaataagaactacttagcttggtaccagaagaaaccaggacagcctcctcaattgctcatttactgggcatctacccgacaatccggggtccctgaccgattcagtggcagcgggtctgggacagatttcactctcaccatcagcagcctgcaggctgaagatgtggcagtttattactgtcagcaatattttagtagtcctcccatattcaccttcggccctgggaccaaagtggagatcaaac

SEQ ID NO: 429 - DNA, 366 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggagtgacttttagctcatacgccattagctgggtgcgacaggctcctggtcagggcctcgaatggatgggcggcattacccctatgtttggtactgcaaattatgcccagaaatttcagggtagagtcacaattaccgcagataaaagtacgagcaccgtctatatggaactgagtagcctgcgttccgaagatacagctgtgtattactgtgcgcgcggtcgtggttacatcgctgttgctggtgacatggacgtgtggggccaggggaccttagtcactgtgtctagc

SEQ ID NO: 430 - DNA, 340 bp, Artificial Sequence
  Description of Artificial Sequence: Synthetic polynucleotide
gacatccagatgacccagtctccagactccctggctgtgtctctgggcgagagggccaccatcaactgcaagtccagtcggagtgttttatacagctccaacaataagaactacttagcttggtaccagcagaaagcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctccgacgttcggccaagggaccaaggtggaaatcaaac

SEQ ID NO: 431 - DNA, 372 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtgttaccttcagttcatacgccattagctgggtgcgacaggctcctggtcagggcctcgaatggatgggcggcattagcccactgttcggtactgcaaattatgcccagaaatttcagggtagagtcacaattaccgcagataagagcacgagcactgcctacatggaactgagtagcctgcgttccgaagatacagctgtgtattactgtgcgcgcggtgacgcttactacgttggtggtggtgctcgtccttttgacctctggggccaggggaccttagtcactgtgtctagc

SEQ ID NO: 432 - DNA, 334 bp, Artificial Sequence
  Description of Artificial Sequence: Synthetic polynucleotide
tcctatgagctgactcagccaccctcagtgtctgagacccccgggcagaacgtcattatctcttgttctggaggcagctccaacatcggagttaattatgtatactggtatcaggtggtcccaggagcggcccccaaactcctcatctataggaataatcagcggccctcaggggtccctgaccgattctctggctccaagtctggcacctcagcctccctggccatcagtggactccagtctgaggatgaggctgactattactgtggagtatgggatgacagcctgaatggtcattgggtgttcggcggagggaccgacctgaccgtcctgg

SEQ ID NO: 433 - DNA, 375 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtggtccatttagctcatacgccattagctgggtgcgacaggctcctggtcagggcctcgaatggatgggcggcattagccctatgtttggtactgcaaattatgcccagaaatttcagggtagagtcacaattaccgcagatgaaagcacgtcaaccgtgtacatggaactgagtagcctgcgttccgaagatacagctgtgtattactgtgcgcgcggttacagttactaccctggtggtggtggtggtcgtaatttcgactactggggccaggggaccttagtcactgtgtctagc

SEQ ID NO: 434 - DNA, 331 bp, Artificial Sequence
  Description of Artificial Sequence: Synthetic polynucleotide
ctgcctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgagggtgaggctgattattactgtgcagcatgggatgacagcctgaaaggtcgggtgttcggcggagggaccaaggtgaccgtcctag

SEQ ID NO: 435 - DNA, 372 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggaggtccattcagttcttacgccattagctgggtgcgacaggctcctggtcagggcctcgaatggatgggcggcatcagccctctgtttggtactgcaaattatgcccagaaatttcagggtagagtcacaattaccgcagatgaaagcacgtcaaccgcctacatggaactgagtagcctgcgttccgaagatacagctgtgtattactgtgcgcgcgctcctacatactacgctagtcgtgacagttacaatttcgattattggggccaggggaccttagtcactgtgtctagc

SEQ ID NO: 436 - DNA, 325 bp, Artificial Sequence
  Description of Artificial Sequence: Synthetic polynucleotide
gaaacgacactcacgcagtctccagccaccctgtctgtgtctccaggggaaagagccaccctctcctgcagggccagtcagagtgttgacagaggctacttagcctggtatcagcagaagcctggccaggctcccaggctcctcatctatggtgcatcccacagggccgctggcatcccagacaggttcagtggcagtgggtctgggacagacttcactctcaccatcagcagactggagcctgaggattttgcagtatatttctgtcagcagtatggtagttcacgcctctctttcggcggagggaccaaggtggagatccaac

SEQ ID NO: 437 - DNA, 363 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtgtgactttcagttcttacgccattagctgggtgcgacaggctcctggtcagggcctcgaatggatgggcggcattagccctatgttcggtactgcaaattatgcccagaaatttcagggtagagtcacaattaccgcagacaagagcacgaatactgcatatatggaactgagtagcctgcgttccgaagatacagctgtgtattactgtgcgcgcgacacaacatacatcgctggtggtcacttcgacgtttggggccaggggaccttagtcactgtgtctagc

SEQ ID NO: 438 - DNA, 331 bp, Artificial Sequence
  Description of Artificial Sequence: Synthetic polynucleotide
cagtctgtgctgactcagccaccctccgcgtccgggtctcctggacagtcagtcaccatctcctgcactggaaccagcagtgacattggtgcttataactatgtctcctggtaccaacaacacccagacaaagcccccaagctcatcatttatgaggtcagtaagcggccctcaggggtccctgatcgcttctctggctccaagtctggcaacacggcctccctgaccgtctctgggctccaggctgaggatgaggctgattattactgcagctcctatgcaggcagcaacaatgtggtattcggcggagggaccaagctgaccgtcctag

SEQ ID NO: 439 - DNA, 366 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtggtaccttcagctcatacgccattagctgggtgcgacaggctcctggtcagggcctcgaatggatgggcggcatcagccctctgtttggcactgcaaattatgcccagaaatttcagggtagagtcacaattaccgcagatgagagtaccaatactgcctatatggaactgagtagcctgcgttccgaagatacagctgtgtattactgtgcgcgcgctagtggttacttcacaggttggggtacattcgactactggggccaggggaccttagtcactgtgtctagc

SEQ ID NO: 440 - DNA, 319 bp, Artificial Sequence
  Description of Artificial Sequence: Synthetic polynucleotide
tcctatgagctgactcagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccaactctgggaacacagccactctgaccatcagcgggacccaggctttggatgaggctgactattactgtcaggcgtgggacagcagcactgctgtcttcggaactgggaccaaggtcaccgtcctag

SEQ ID NO: 441 - DNA, 363 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggaggtacttttagttcttacgccattagctgggtgcgacaggctcctggtcagggcctcgaatggatgggcggcatcagccctatctttggtactgcaaattatgcccagaaatttcagggtagagtcacaattaccgcagacaagagcacgagcaccgcctacatggaactgagtagcctgcgttccgaagatacagctgtgtattactgtgcgcgcggtcgttactactacacagttggtgtttatgacgtttggggccaggggaccttagtcactgtgtctagc

SEQ ID NO: 442 - DNA, 331 bp, Artificial Sequence
  Description of Artificial Sequence: Synthetic polynucleotide
tcctatgagctgactcagccaccctcggtgtccaagggcttgagacagaccgccaccctcacctgcattggggacagcgacaatgttggcaaccaaggagtaggttggctgcagcagcaccagggccaccctcccaaactcctgtcctacagggataacacccggccctcaggcatctcagagagattctctgcatccaggtcaggaaacacagcctccctgaccattactggactccagcctgaggacgaggctgactattactgctcagcatgggacagcagcctcactgccgtggtgttcggcggagggaccaagctggccgtcctag

SEQ ID NO: 443 - DNA, 381 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtgttaccttcagttcttacgccattagctgggtgcgacaggctcctggtcagggcctcgaatggatgggcggcattagccctatctttggcactgcaaattatgcccagaaatttcagggtagagtcacaattaccgcagataaaagtacctcaaccgtctacatggaactgagtagcctgcgttccgaagatacagctgtgtattactgtgcgcgcggtggtggttacagtgctgacggtggtgctggtaataatacaatcttcgacgtttggggccaggggaccttagtcactgtgtctagc

SEQ ID NO: 444 - DNA, 331 bp, Artificial Sequence
  Description of Artificial Sequence: Synthetic polynucleotide
cagcctgtgctgactcagccaccctcggtgtccaagggcttgagacagaccgccacactcacctgtactgggaacaacaacaatgttggcaaccaaggagcagcctggctgcagcagcaccagggccaccctcccaaactcctatccgacaggaataacaaccggccctcagggatctcagagagattatctgcatccaggtcaggaaatacagcctccctgaccattactggactccaggctgaggacgaggctgactattactgctcagcatgggacagcagcctcagtgcttgggtgttcggcggagggaccaagctgaccgtcctaa

SEQ ID NO: 445 - DNA, 366 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggagttacttttagctcttacgccattagctgggtgcgacaggctcctggtcagggcctcgaatggatgggcggcattagccctctgtttggtactgcaaattatgcccagaaatttcagggtagagtcacaattaccgcagatgagagtacctcaactgcatatatggaactgagtagcctgcgttccgaagatacagctgtgtattactgtgcgcgcgagcgtggttacacagttggtggtggtggtatggacgtgtggggccaggggaccttagtcactgtgtctagc

SEQ ID NO: 446 - DNA, 334 bp, Artificial Sequence
  Description of Artificial Sequence: Synthetic polynucleotide
cagtctgccctgactcagcctccctccgcgtccgggtctcctggacagtcagtcaccatctcctgcactggaaccagcagtgacgttggtgctcacaactttgtctcctggtaccaacaacacccagacaaagcccccaaactcatcatttatgaggtcaataggcggccctcaggggtccctgatcgcttctctggctccaagtctggcacctcagcctccctggccatcagtggtctccagtctgacgatgaggctgactattactgtgcagcatgggacgacagtctcgatggtccggtgttcggcggagggaccaagctgaccgtcctag

SEQ ID NO: 447 - DNA, 372 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggagttacttttagctcatacgccattagctgggtgcgacaggctcctggtcagggcctcgaatggatgggcggcatcagcccaatctttggtactgcaaattatgcccagaaatttcagggtagagtcacaattaccgcagacaagagcacgaacactgtgtacatggaactgagtagcctgcgttccgaagatacagctgtgtattactgtgcgcgcgagtacctgggtgacgactacagtagtggtagttacttcgatgtgtggggccaggggaccttagtcactgtgtctagc

SEQ ID NO: 448 - DNA, 322 bp, Artificial Sequence
  Description of Artificial Sequence: Synthetic polynucleotide
gaaacgacactcacgcagtctccaggcacactgtctttgtctccaggggaaacagccatcctctcctgtagggccagtcagagtgttgatagtcacttagcctggtaccaacaaaaaggtggccaggctcccaggctcctcatctatggtgcatccaccagggccactggtatcccagccaggttcagtggcagtgggtctgggacagacttcactctcaccatcaatggcctagagcctgaggattttgcaatttatttctgtcagcagcgcagcatgtggcccctcactttcggcggagggaccaaggtggagatcaaac

SEQ ID NO: 449 - DNA, 363 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggaggtactttcagttcatacgccattagctgggtgcgacaggctcctggtcagggcctcgaatggatgggcggcattagccctatgtttggtactgcaaattatgcccagaaatttcagggtagagtcacaattaccgcagacaaaagtacctcaactgcatatatggaactgagtagcctgcgttccgaagatacagctgtgtattactgtgcgcgcgagagtggttacagtggtacaggtcaatttgacgtgtggggccaggggaccttagtcactgtgtctagc

SEQ ID NO: 450 - DNA, 331 bp, Artificial Sequence
  Description of Artificial Sequence: Synthetic polynucleotide
cagtctgtgctgactcagccaccctcagcgtctgggaccgccgggcagagggtcacaatctcctgttttgggagaacctccaacgtcggacgaaacactgttaactggtaccaacaattgcccggagcggcccccaagatcctcatttttaacgataatcaacggccctcgggggtccctgaccgcttctctggctccaagtctggcaccgccgcctccctgaccataagtaggctccagtccgcggatgaggctgattactattgttcatcatgggatgacgacctgaacggtccggtcttcggcggagggaccaagctgagcgtcgtag

SEQ ID NO: 451 - DNA, 366 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggaggtatctttagttcttacgccattagctgggtgcgacaggctcctggtcagggcctcgaatggatgggcggcattagcccaatcttcggtactgcaaattatgcccagaaatttcagggtagagtcacaattaccgcagatgagagcacgaacaccgcctatatggaactgagtagcctgcgttccgaagatacagctgtgtattactgtgcgcgcagtggtggttactacgactacggtgttggttacgaccaatggggccaggggaccttagtcactgtgtctagc

SEQ ID NO: 452 - DNA, 322 bp, Artificial Sequence
  Description of Artificial Sequence: Synthetic polynucleotide
cagcctgtgctgactcagccaccctcagcgtctgggacccccgggcagagggtcaccatctcttgttctggaggcaggtccaacatcggaagtaatactgttaactggtaccagcagctcccaggaacggcccccaaactcctcatctatagtaataatcaccggccctcaggggtccctgatcgcttctctggctccaagtctggcaacacggcctccctgaccatctctgggctccaggcggaggatgaggctgattattactgccagtcctatgacagcagcgttgtattcggcggagggaccaagctgaccgtcctag

SEQ ID NO: 453 - DNA, 366 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtggtaccttcagctcttacgccattagctgggtgcgacaggctcctggtcagggcctcgaatggatgggcggcattacccctatctttggcactgcaaattatgcccagaaatttcagggtagagtcacaattaccgcagacgagagtaccagcactgcctacatggaactgagtagcctgcgttccgaagatacagctgtgtattactgtgcgcgcagtggtggttacagtcctagtatcggtggtttcgacgtttggggccaggggaccttagtcactgtgtctagc

SEQ ID NO: 454 - DNA, 331 bp, Artificial Sequence
  Description of Artificial Sequence: Synthetic polynucleotide
cagcctgggctgactcagccaccctcagcgtctgggacccccgggcagagggtcaccatctcttgttctggaagcaggtccaatatcggaagaaatactgtaaactggtaccagcaactcccaggaacggcccccaaactcctcatctatagtaacaatcagcggccctcaggggtccctgaccgagtctctggctccaagtctggcacctcagcctccctggccatcagtgggctccagtctgaggatgaggctgattattactgtgcagcatgggatgtgagcctgaatggtcaggtcttcggaactgggaccaaggtcaccgtcctag

SEQ ID NO: 455 - DNA, 369 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggaggtacctttagttcatacgccattagctgggtgcgacaggctcctggtcagggcctcgaatggatgggcggcatcagcccaatctttggtactgcaaattatgcccagaaatttcagggtagagtcacaattaccgcagatcgcagtacgagcaccgcctacatggaactgagtagcctgcgttccgaagatacagctgtgtattactgtgcgcgcggtcctggttacgaccctagtagtctgcgtggttttgacgtttggggccaggggaccttagtcactgtgtctagc

SEQ ID NO: 456 - DNA, 330 bp, Artificial Sequence
  Description of Artificial Sequence: Synthetic polynucleotide
tcctatgagctgactcagccaccctcggtgtccaaggacttgagacagaccgccacactcacctgcactgggaacagcaacaatgttggcaaccaaggagcagcttggctgcagcagcaccagggccaccctcccaaactcctattctacaagaataacaaccggccctcagggatttcagagagattatctgcatccaggtcaggaaacacagcctccctgaccattactggactccagcctgaggacgaggctgactattactgctcagcatgggacagcagcctcagtgattgggtgttcggcggagggaccaagctgaccgtccta

SEQ ID NO: 457 - DNA, 351 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtggcacttttagctcttacgccattagctgggtgcgacaggctcctggtcagggcctcgaatggatgggcggcatcattccaatctttggtactgcaaattatgcccagaaatttcagggtagagtcacaattaccgcagatgagagcacgaatactgcctacatggaactgagtagcctgcgttccgaagatacagctgtgtattactgtgcgcgcggtgaggaggcttactacgacctttggggccaggggaccttagtcactgtgtctagc

SEQ ID NO: 458 - DNA, 322 bp, Artificial Sequence
  Description of Artificial Sequence: Synthetic polynucleotide
gaaattgtgttgacgcagtctccaggcaccctgtctttgtctccaggggaaagagccaccctctcctgctgggccagtcagagtgttagcagcttcttagcctggtaccaacacaaacctggccaggttcccaggctcctcatctatgatgcatccaatagggccactggcatcccagccaggttctctggcagtgggtctgggacacacttcactctcactatcagcagcctagagcctgaagattttgcagtttattactgtcagcagcgtttcaattggcctccgacgttcggccaagggaccaaggtggaaagcaaac

SEQ ID NO: 459 - DNA, 366 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggaggtacttttagttcatacgccattagctgggtgcgacaggctcctggtcagggcctcgaatggatgggcggcatcacccctatgttcggcactgcaaattatgcccagaaatttcagggtagagtcacaattaccgcagacaaaagtacgagcaccgcctatatggaactgagtagcctgcgttccgaagatacagctgtgtattactgtgcgcgcggtacaagttacctgcctggtcgtagtggttttgatgtttggggccaggggaccttagtcactgtgtctagc

SEQ ID NO: 460 - DNA, 322 bp, Artificial Sequence
  Description of Artificial Sequence: Synthetic polynucleotide
cagcctgggctgactcagccaccctcggtgtcagtgtccccaggacagacggccaggatcacctgctctgcagatgcattgccaaagcaatatgcttattggtaccagcagaggccaggccaggcccctgtgttgctgatatataaagacactgagaggcccccagggatccctgagcgattctctggctccagctcagggacaacagtcacgttgaccatcagtggagtccaggcagaagacgaggctgactactattgtcaatcagcagacgctagtgaaaattctgtcttcggaggtgggaccaaggtcaccgtcctag

SEQ ID NO: 461 - DNA, 366 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtgttacttttcgttcatacgccattagctgggtgcgacaggctcctggtcagggcctcgaatggatgggcggcatcagcgcaatgtttggtactgcaaattatgcccagaaatttcagggtagagtcacaattaccgcagacaagagtacgaacaccgcatatatggaactgagtagcctgcgttccgaagatacagctgtgtattactgtgcgcgcggtcgtggttacgaccctagtgttggtggttttgatgtgtggggccaggggaccttagtcactgtgtctagc

SEQ ID NO: 462 - DNA, 331 bp, Artificial Sequence
  Description of Artificial Sequence: Synthetic polynucleotide
aattttatgctgactcagccccactctgtgtcggagtctccggggaagacggtcagcatctcctgcaccggcagcagtggcagcattgccagcaactatgtgcagtggtaccagcagcgcccgggcagtgcccccgccactgtgatctatgaggataaccaaagaccctctggggtccctgatcggttctctggctccatcgacagctcctccaactctgcctccctcaccatctctggactgaagactgaggacgaggctgactactactgtcagtcttatgataccagcaatctggtattcggcgtagggaccaagctgaccgtcctag

SEQ ID NO: 463 - DNA, 381 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtggtacctttagttcatacgccattagctgggtgcgacaggctcctggtcagggcctcgaatggatgggcggcattattcctatcttcggtactgcaaattatgcccagaaatttcagggtagagtcacaattaccgcagacgatagcacgtcaaccgcatacatggaactgagtagcctgcgttccgaagatacagctgtgtattactgtgcgcgcgacagtacacctagtgttacaagtagtctgtaccgtatccctgcttttgatgtgtggggccaggggaccttagtcactgtgtctagc

SEQ ID NO: 464 - DNA, 337 bp, Artificial Sequence
  Description of Artificial Sequence: Synthetic polynucleotide
ctgcctgtgctgactcaatcatcctctgcctctgcttccctgggatcctcggtcaagctcacctgcagtctgaccaatgggcccagtaactacatcatcgcatggcatcagcagcagccagagaagggccctcggtacttgatgaagcttaacagtgatggcagccacagcaagggggacgggatccctgatcgcttctcaggctccagctctggggctgagcgctacctcaccatctccaaccttaagtctgaggatgaggctgattattactgtgagacctgggacagtaacactcatgtggtattcggcggagggaccaagctgaccgtcctag

SEQ ID NO: 465 - DNA, 366 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggaggtacctttagttcatacgccattagctgggtgcgacaggctcctggtcagggcctcgaatggatgggcggcattaccccaatgtttggtactgcaaattatgcccagaaatttcagggtagagtcacaattaccgcagacaagagcacgtcaactacatacatggaactgagtagcctgcgttccgaagatacagctgtgtattactgtgcgcgcggtcctggttactaccctgacagtaataattatgatctctggggccaggggaccttagtcactgtgtctagc

SEQ ID NO: 466 - DNA, 325 bp, Artificial Sequence
  Description of Artificial Sequence: Synthetic polynucleotide
gaaacgacactcacgcagtctccaggcaccctgtctttgtctccaggggaaagagccaccctctcctgcagggccagtcagagtgttagtagcagctacttagcctggtaccagcagaaacctggccaggctcccaggctcctcatctatggtgcatcaagtagggccactggcatcccagacaggttcagtggcagtgggtctgggacagacttcactctcaccatcagcagactggagcctgaagattttgcaacctactattgtcaacaggttaacagcttccctcgaacttttggccaggggaccaagctggagatgaaac

SEQ ID NO: 467 - DNA, 366 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtgtgacctttagctcatacgccattagctgggtgcgacaggctcctggtcagggcctcgaatggatgggcggcattagcccaatgtttggcactgcaaattatgcccagaaatttcagggtagagtcacaattaccgcagaccagagcacgaacaccgcctatatggaactgagtagcctgcgttccgaagatacagctgtgtattactgtgcgcgcggtggtacatacagtcctggtggtacatactttgatgtttggggccaggggaccttagtcactgtgtctagc

SEQ ID NO: 468 - DNA, 331 bp, Artificial Sequence
  Description of Artificial Sequence: Synthetic polynucleotide
cagcctgtgctgactcagccaccctcagcgtctgcgacccccggacagacggtgaccatctcttgttctggcagcagttccaacatcggcgtgagctttgtctactggtatcaacaatttccaggaacggcccccaagctcctcatttacagggatgatatgaggcagtcaggggtccctgaccgattttctggcttcaagtctggctcctcagcctccctgaccatctctgggctccagtccgaagatgaggccacttattattgttccgcgtgggatgagagcctgagtagtgtgttgttcggcggagggaccaaggtcaccgtcctag

SEQ ID NO: 469 - protein, 124 aa, Artificial Sequence
  Description of Artificial Sequence: Synthetic polypeptide
QVQLVQSGAEVKKPGSSVKVSCKASGGPFSSYAISWVRQAPGQGLEWMGGISPMFGTANYAQKFQGRVTITADKSTSTAYMELSSLRSEDTAVYYCARDDGYAPSGGLREFDVWGQGTLVTVSS

SEQ ID NO: 470 - protein, 113 aa, Artificial Sequence
  Description of Artificial Sequence: Synthetic polypeptide
DIQMTQSPDSLAVSLGERATINCKSSRSVLYSSNNKNYLAWYQQKPGQPPKLLIYWASTRESGVPDRFSGSGSGTDFTLTISSLQAEDVAVYYCQQYYSGSWTFGQGTKVEIK

SEQ ID NO: 471 - protein, 121 aa, Artificial Sequence
  Description of Artificial Sequence: Synthetic polypeptide
QVQLVQSGAEVKKPGSSVKVSCKASGGIFSSYAISWVRQAPGQGLEWMGGISPIFGTANYAQKFQGRVTITADKSTNTAYMELSSLRSEDTAVYYCARGRGAYMGPSMDVWGQGTLVTVSS

SEQ ID NO: 472 - protein, 108 aa, Artificial Sequence
  Description of Artificial Sequence: Synthetic polypeptide
QPVLTQPPSVSVAPGQTARITCGGNNIGSKSVHWYQQKPGQAPVLVVYDDSDRPSGIPERFSGSNSGNTATLTISRVEAGDEADYYCQVWDRSSDHVVFGGGTKLTVL

SEQ ID NO: 473 - protein, 121 aa, Artificial Sequence
  Description of Artificial Sequence: Synthetic polypeptide
QVQLVQSGAEVKKPGSSVKVSCKASGGTFSSYAISWVRQAPGQGLEWMGGISPIFGTANYAQKFQGRVTITADKSTSTVYMELSSLRSEDTAVYYCARGARYYAGGYFDVWGQGTLVTVSS

SEQ ID NO: 474 - protein, 108 aa, Artificial Sequence
  Description of Artificial Sequence: Synthetic polypeptide
EIVLTQSPGTLSLSPGERATLSCRASQTVSNYLAWYQQRPGQAPRLLIYAASTRATGVPARFSGSGSGTEFTLTISSLQSEDFAIYYCQQYDNLPPVTFGPGTTVDIK

SEQ ID NO: 475 - protein, 125 aa, Artificial Sequence
  Description of Artificial Sequence: Synthetic polypeptide
QVQLVQSGAEVKKPGSSVKVSCKASGVTFSSYAISWVRQAPGQGLEWMGGISPIFGTANYAQKFQGRVTITADQSTNTVYMELSSLRSEDTAVYYCARDSGNYDGYGPGSRFDVWGQGTLVTVSS

SEQ ID NO: 476 - protein, 110 aa, Artificial Sequence
  Description of Artificial Sequence: Synthetic polypeptide
QPGLTQPPSASGTPGQRVTISCSGSSSNIGSNTVNWYQQLPGTAPKLLIYSNNQRPSGVPDRFSGSKSGTSASLAISGLQSEDEADYFCSAWDDSLGGEVFGTGTKVNVL

SEQ ID NO: 477 - protein, 121 aa, Artificial Sequence
  Description of Artificial Sequence: Synthetic polypeptide
QVQLVQSGAEVKKPGSSVKVSCKASGVTFSSYAISWVRQAPGQGLEWMGGIMPMFGTANYAQKFQGRVTITADKSTSTAYMELSSLRSEDTAVYYCARERGSWSFGYFDVWGQGTLVTVSS

SEQ ID NO: 478 - protein, 108 aa, Artificial Sequence
  Description of Artificial Sequence: Synthetic polypeptide
LPVLTQPPSMSAAPGQTARITCGGDHIGSKSVHWYQRKPGQAPVLVIYSDTDRPSGIPERFSGSNSGNTATLTISRVEAGDEADYFCQVWDSSNDHPVFGGGTKLTVL

SEQ ID NO: 479 - protein, 121 aa, Artificial Sequence
  Description of Artificial Sequence: Synthetic polypeptide
QVQLVQSGAEVKKPGSSVKVSCKASGVTFSSYAISWVRQAPGQGLEWMGGISPLFGTANYAQKFQGRVTITADKSTSTVYMELSSLRSEDTAVYYCARSRTYADGRTFDVWGQGTLVTVSS

SEQ ID NO: 480 - protein, 121 aa, Artificial Sequence; identical to SEQ ID NO: 479
  Description of Artificial Sequence: Synthetic polypeptide

SEQ ID NO: 481 - protein, 124 aa, Artificial Sequence
  Description of Artificial Sequence: Synthetic polypeptide
QVQLVQSGAEVKKPGSSVKVSCKASGGTFSSYAISWVRQAPGQGLEWMGGISPIFGTANYAQKFQGRVTITADKSTSTAYMELSSLRSEDTAVYYCARELGYLAGSPSPGFDYWGQGTLVTVSS

SEQ ID NO: 482 - protein, 109 aa, Artificial Sequence
  Description of Artificial Sequence: Synthetic polypeptide
QSVLTQPPSASGSPGQSVTISCTGTSSDVGGYNYVSWYQQHPGKAPKLIIYEVTKRPSGVPDRFSGSKSGNTASLTVAGLQAEDEADYYCSSYAGGKWVFGTGTKVTVL

SEQ ID NO: 483 - protein, 121 aa, Artificial Sequence
  Description of Artificial Sequence: Synthetic polypeptide
QVQLVQSGAEVKKPGSSVKVSCKASGGTFSSYAISWVRQAPGQGLEWMGGISPIFGTANYAQKFQGRVTITADTSTSTAYMELSSLRSEDTAVYYCARSRRYWADGGFDYWGQGTLVTVSS

SEQ ID NO: 484 - protein, 110 aa, Artificial Sequence
  Description of Artificial Sequence: Synthetic polypeptide
LPVLTQPPSASGTPGQRVTISCSGSSSNMGRNTVNWYRHLPGTAPELLIYDNDERPSGVPDRFSGSKSGTSASLAISGLQSEDEGHYYCAAWDDSLNGPVFGGGTKLTVL

SEQ ID NO: 485 - protein, 122 aa, Artificial Sequence
  Description of Artificial Sequence: Synthetic polypeptide
QVQLVQSGAEVKKPGSSVKVSCKASGGTFSSYAISWVRQAPGQGLEWMGGISPMFGTANYAQKFQGRVTITADKSTSTAYMELSSLRSEDTAVYYCAREGGYSPGGVDFDYWGQGTLVTVSS

SEQ ID NO: 486 - protein, 110 aa, Artificial Sequence
  Description of Artificial Sequence: Synthetic polypeptide
NFMLTQPHSVSESPGKTVTISCTRSSGSIASTYVQWYRQRPGSAPTTVIYEDHQRPSGVPDRFSGSLDSSSNSASLTISGLRTEDAATYYCQSFDASTLVFGGGTKLTVL

SEQ ID NO: 487 - protein, 121 aa, Artificial Sequence
  Description of Artificial Sequence: Synthetic polypeptide
QVQLVQSGAEVKKPGSSVKVSCKASGVTFSSYAISWVRQAPGQGLEWMGGISPIFGTANYAQKFQGRVTITADESTNTVYMELSSLRSEDTAVYYCARGTTYSTARYFDVWGQGTLVTVSS

SEQ ID NO: 488 - protein, 112 aa, Artificial Sequence
  Description of Artificial Sequence: Synthetic polypeptide
NFMLTQPHSVSESPGKTVTISCTRRSGSIASNYVQWYQQRPGSAPTTVIYEDNQRPSGVPDRFSGSIDRSSNSASLTISGLKTEDEADYYCQSYDSDNHEVIFGGGTKLTVL

SEQ ID NO: 489 - protein, 121 aa, Artificial Sequence
  Description of Artificial Sequence: Synthetic polypeptide
QVQLVQSGAEVKKPGSSVKVSCKASGVTFRSYAISWVRQAPGQGLEWMGGISGIFGTANYAQKFQGRVTITADESTSTAYMELSSLRSEDTAVYYCARSPAYYFGPNMDVWGQGTLVTVSS

SEQ ID NO: 490 - protein, 111 aa, Artificial Sequence
  Description of Artificial Sequence: Synthetic polypeptide
QSVLTQPPSVSGAPGQRVTISCTGSSSNIGAGYDVHWYQQLPGTVPKLIIYDNSNRPSGVPARFSGSKSGTSASLAISGLQSEDEAAYYCQSYDSSLSVVVFGGGTKLSVL

SEQ ID NO: 491 - protein, 123 aa, Artificial Sequence
  Description of Artificial Sequence: Synthetic polypeptide
QVQLVQSGAEVKKPGSSVKVSCKASGGTFSSYAISWVRQAPGQGLEWMGGISPMFGTANYAQKFQGRVTITADKSTSTAYMELSSLRSEDTAVYYCARSSRYAPSDSTNFDQWGQGTLVTVSS

SEQ ID NO: 492 - protein, 111 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDTSNRKVFGGGTKLTVL

SEQ ID NO: 493 - protein, 121 aa, Artificial Sequence
  Description of Artificial Sequence: Synthetic polypeptide
QVQLVQSGAEVKKPGSSVKVSCKASGGPFSSYAISWVRQAPGQGLEWMGGISGIFGTANYAQKFQGRVTITADESTSTAYMELSSLRSEDTAVYYCARGDRFYVGERFDVWGQGTLVTVSS

SEQ ID NO: 494 - protein, 109 aa, Artificial Sequence
  Description of Artificial Sequence: Synthetic polypeptide
QSVLTQPPSVSVAPGQTARITCGGNDIGSKSVHWYQQKPGQAPVLVVYDDIDRPSGIPERFSGSNYGDTATLTISWVEAGDEADYYCQVWDTNSDPVFVFGSGTKVTVL

SEQ ID NO: 495 - protein, 125 aa, Artificial Sequence
  Description of Artificial Sequence: Synthetic polypeptide
QVQLVQSGAEVKKPGSSVKVSCKASGGTFSSYAISWVRQAPGQGLEWMGGISPIFGTANYAQKFQGRVTITADQSTSTAYMELSSLRSEDTAVYYCARGGGVGRIWIAGYGFDQWGQGTLVTVSS

SEQ ID NO: 496 - protein, 110 aa, Artificial Sequence
  Description of Artificial Sequence: Synthetic polypeptide
QTVVTQEPSFSVSPGGTVTLTCGLSSGSVSTSNYPSWYQQTPGQPPRTLIYSTNTRSSGVPDRFSGSILGNKAALTITGAQADDESDYYCVLYMGSGISMFGGGTKLTVL

SEQ ID NO: 497 - protein, 125 aa, Artificial Sequence
  Description of Artificial Sequence: Synthetic polypeptide
QVQLVQSGAEVKKPGSSVKVSCKASGGTFSSYAISWVRQAPGQGLEWMGGISPIFGTANYAQKFQGRVTITADESTSTVYMELSSLRSEDTAVYYCARGPGYHPAGASGQFFDLWGQGTLVTVSS

SEQ ID NO: 498 - protein, 110 aa, Artificial Sequence
  Description of Artificial Sequence: Synthetic polypeptide
SYELTQPPSVSKDLRQTATLTCTGNSNNVGNQGAAWLQQHQGHPPKLLSYRNNHRPSGISDRSSASRSGDTASLTITGLQPEDEADYYCSAWDSSLSAWVFGGGTKLTVL

SEQ ID NO: 499 - protein, 123 aa, Artificial Sequence
  Description of Artificial Sequence: Synthetic polypeptide
QVQLVQSGAEVKKPGSSVKVSCKASGVTFSSYAISWVRQAPGQGLEWMGGISPMFGTANYAQKFQGRVTITADESTNTAYMELSSLRSEDTAVYYCARGRGYAPDALTNFDVWGQGTLVTVSS

SEQ ID NO: 500 - protein, 115 aa, Artificial Sequence
  Description of Artificial Sequence: Synthetic polypeptide
EIVLTQSPDSLAMSLGERATVNCKSSRSLFDSSDNKNYLAWYQKKPGQPPQLLIYWASTRQSGVPDRFSGSGSGTDFTLTISSLQAEDVAVYYCQQYFSSPPIFTFGPGTKVEIK

SEQ ID NO: 501 - protein, 122 aa, Artificial Sequence
  Description of Artificial Sequence: Synthetic polypeptide
QVQLVQSGAEVKKPGSSVKVSCKASGVTFSSYAISWVRQAPGQGLEWMGGITPMFGTANYAQKFQGRVTITADKSTSTVYMELSSLRSEDTAVYYCARGRGYIAVAGDMDVWGQGTLVTVSS

SEQ ID NO: 502 - protein, 113 aa, Artificial Sequence
  Description of Artificial Sequence: Synthetic polypeptide
DIQMTQSPDSLAVSLGERATINCKSSRSVLYSSNNKNYLAWYQQKAGQPPKLLIYWASTRESGVPDRFSGSGSGTDFTLTISSLQAEDVAVYYCQQYYSTPPTFGQGTKVEIK

SEQ ID NO: 503 - protein, 124 aa, Artificial Sequence
  Description of Artificial Sequence: Synthetic polypeptide
QVQLVQSGAEVKKPGSSVKVSCKASGVTFSSYAISWVRQAPGQGLEWMGGISPLFGTANYAQKFQGRVTITADKSTSTAYMELSSLRSEDTAVYYCARGDAYYVGGGARPFDLWGQGTLVTVSS

SEQ ID NO: 504 - protein, 111 aa, Artificial Sequence
  Description of Artificial Sequence: Synthetic polypeptide
SYELTQPPSVSETPGQNVIISCSGGSSNIGVNYVYWYQVVPGAAPKLLIYRNNQRPSGVPDRFSGSKSGTSASLAISGLQSEDEADYYCGVWDDSLNGHWVFGGGTDLTVL

SEQ ID NO: 505 - protein, 125 aa, Artificial Sequence
  Description of Artificial Sequence: Synthetic polypeptide
QVQLVQSGAEVKKPGSSVKVSCKASGGPFSSYAISWVRQAPGQGLEWMGGISPMFGTANYAQKFQGRVTITADESTSTVYMELSSLRSEDTAVYYCARGYSYYPGGGGGRNFDYWGQGTLVTVSS

SEQ ID NO: 506 - protein, 110 aa, Artificial Sequence
  Description of Artificial Sequence: Synthetic polypeptide
LPVLTQPPSASGTPGQRVTISCSGSSSNIGSNTVNWYQQLPGTAPKLLIYSNNQRPSGVPDRFSGSKSGTSASLAISGLQSEGEADYYCAAWDDSLKGRVFGGGTKVTVL

SEQ ID NO: 507 - protein, 124 aa, Artificial Sequence
  Description of Artificial Sequence: Synthetic polypeptide
QVQLVQSGAEVKKPGSSVKVSCKASGGPFSSYAISWVRQAPGQGLEWMGGISPLFGTANYAQKFQGRVTITADESTSTAYMELSSLRSEDTAVYYCARAPTYYASRDSYNFDYWGQGTLVTVSS

SEQ ID NO: 508 - protein, 108 aa, Artificial Sequence
  Description of Artificial Sequence: Synthetic polypeptide
ETTLTQSPATLSVSPGERATLSCRASQSVDRGYLAWYQQKPGQAPRLLIYGASHRAAGIPDRFSGSGSGTDFTLTISRLEPEDFAVYFCQQYGSSRLSFGGGTKVEIQ

SEQ ID NO: 509 - protein, 121 aa, Artificial Sequence
  Description of Artificial Sequence: Synthetic polypeptide
QVQLVQSGAEVKKPGSSVKVSCKASGVTFSSYAISWVRQAPGQGLEWMGGISPMFGTANYAQKFQGRVTITADKSTNTAYMELSSLRSEDTAVYYCARDTTYIAGGHFDVWGQGTLVTVSS

SEQ ID NO: 510 - protein, 110 aa, Artificial Sequence
  Description of Artificial Sequence: Synthetic polypeptide
QSVLTQPPSASGSPGQSVTISCTGTSSDIGAYNYVSWYQQHPDKAPKLIIYEVSKRPSGVPDRFSGSKSGNTASLTVSGLQAEDEADYYCSSYAGSNNVVFGGGTKLTVL

SEQ ID NO: 511 - protein, 122 aa, Artificial Sequence
  Description of Artificial Sequence: Synthetic polypeptide
QVQLVQSGAEVKKPGSSVKVSCKASGGTFSSYAISWVRQAPGQGLEWMGGISPLFGTANYAQKFQGRVTITADESTNTAYMELSSLRSEDTAVYYCARASGYFTGWGTFDYWGQGTLVTVSS

SEQ ID NO: 512 - protein, 106 aa, Artificial Sequence
  Description of Artificial Sequence: Synthetic polypeptide
SYELTQPPSVSVSPGQTARITCSGDALPKQYAYWYQQKPGQAPVLVIYKDSERPSGIPERFSGSNSGNTATLTISGTQALDEADYYCQAWDSSTAVFGTGTKVTVL

SEQ ID NO: 513 - protein, 121 aa, Artificial Sequence
  Description of Artificial Sequence: Synthetic polypeptide
QVQLVQSGAEVKKPGSSVKVSCKASGGTFSSYAISWVRQAPGQGLEWMGGISPIFGTANYAQKFQGRVTITADKSTSTAYMELSSLRSEDTAVYYCARGRYYYTVGVYDVWGQGTLVTVSS

SEQ ID NO: 514 - protein, 110 aa, Artificial Sequence
  Description of Artificial Sequence: Synthetic polypeptide
SYELTQPPSVSKGLRQTATLTCIGDSDNVGNQGVGWLQQHQGHPPKLLSYRDNTRPSGISERFSASRSGNTASLTITGLQPEDEADYYCSAWDSSLTAVVFGGGTKLAVL

SEQ ID NO: 515 - protein, 127 aa, Artificial Sequence
  Description of Artificial Sequence: Synthetic polypeptide
QVQLVQSGAEVKKPGSSVKVSCKASGVTFSSYAISWVRQAPGQGLEWMGGISPIFGTANYAQKFQGRVTITADKSTSTVYMELSSLRSEDTAVYYCARGGGYSADGGAGNNTIFDVWGQGTLVTVSS

SEQ ID NO: 516 - protein, 110 aa, Artificial Sequence
  Description of Artificial Sequence: Synthetic polypeptide
QPVLTQPPSVSKGLRQTATLTCTGNNNNVGNQGAAWLQQHQGHPPKLLSDRNNNRPSGISERLSASRSGNTASLTITGLQAEDEADYYCSAWDSSLSAWVFGGGTKLTVL

SEQ ID NO: 517 - protein, 122 aa, Artificial Sequence
  Description of Artificial Sequence: Synthetic polypeptide
QVQLVQSGAEVKKPGSSVKVSCKASGVTFSSYAISWVRQAPGQGLEWMGGISPLFGTANYAQKFQGRVTITADESTSTAYMELSSLRSEDTAVYYCARERGYTVGGGGMDVWGQGTLVTVSS

SEQ ID NO: 518 - protein, 111 aa, Artificial Sequence
  Description of Artificial Sequence: Synthetic polypeptide
QSALTQPPSASGSPGQSVTISCTGTSSDVGAHNFVSWYQQHPDKAPKLIIYEVNRRPSGVPDRFSGSKSGTSASLAISGLQSDDEADYYCAAWDDSLDGPVFGGGTKLTVL

SEQ ID NO: 519 - protein, 124 aa, Artificial Sequence
  Description of Artificial Sequence: Synthetic polypeptide
QVQLVQSGAEVKKPGSSVKVSCKASGVTFSSYAISWVRQAPGQGLEWMGGISPIFGTANYAQKFQGRVTITADKSTNTVYMELSSLRSEDTAVYYCAREYLGDDYSSGSYFDVWGQGTLVTVSS

SEQ ID NO: 520 - protein, 107 aa, Artificial Sequence
  Description of Artificial Sequence: Synthetic polypeptide
ETTLTQSPGTLSLSPGETAILSCRASQSVDSHLAWYQQKGGQAPRLLIYGASTRATGIPARFSGSGSGTDFTLTINGLEPEDFAIYFCQQRSMWPLTFGGGTKVEIK

SEQ ID NO: 521 - protein, 121 aa, Artificial Sequence
  Description of Artificial Sequence: Synthetic polypeptide
QVQLVQSGAEVKKPGSSVKVSCKASGGTFSSYAISWVRQAPGQGLEWMGGISPMFGTANYAQKFQGRVTITADKSTSTAYMELSSLRSEDTAVYYCARESGYSGTGQFDVWGQGTLVTVSS

SEQ ID NO: 522 - protein, 110 aa, Artificial Sequence
  Description of Artificial Sequence: Synthetic polypeptide
QSVLTQPPSASGTAGQRVTISCFGRTSNVGRNTVNWYQQLPGAAPKILIFNDNQRPSGVPDRFSGSKSGTAASLTISRLQSADEADYYCSSWDDDLNGPVFGGGTKLSVV

SEQ ID NO: 523 - protein, 122 aa, Artificial Sequence
  Description of Artificial Sequence: Synthetic polypeptide
QVQLVQSGAEVKKPGSSVKVSCKASGGIFSSYAISWVRQAPGQGLEWMGGISPIFGTANYAQKFQGRVTITADESTNTAYMELSSLRSEDTAVYYCARSGGYYDYGVGYDQWGQGTLVTVSS

SEQ ID NO: 524 - protein, 107 aa, Artificial Sequence
  Description of Artificial Sequence: Synthetic polypeptide
QPVLTQPPSASGTPGQRVTISCSGGRSNIGSNTVNWYQQLPGTAPKLLIYSNNHRPSGVPDRFSGSKSGNTASLTISGLQAEDEADYYCQSYDSSVVFGGGTKLTVL

SEQ ID NO: 525 - protein, 122 aa, Artificial Sequence
  Description of Artificial Sequence: Synthetic polypeptide
QVQLVQSGAEVKKPGSSVKVSCKASGGTFSSYAISWVRQAPGQGLEWMGGITPIFGTANYAQKFQGRVTITADESTSTAYMELSSLRSEDTAVYYCARSGGYSPSIGGFDVWGQGTLVTVSS

SEQ ID NO: 526 - protein, 110 aa, Artificial Sequence
  Description of Artificial Sequence: Synthetic polypeptide
QPGLTQPPSASGTPGQRVTISCSGSRSNIGRNTVNWYQQLPGTAPKLLIYSNNQRPSGVPDRVSGSKSGTSASLAISGLQSEDEADYYCAAWDVSLNGQVFGTGTKVTVL

SEQ ID NO: 527 - protein, 123 aa, Artificial Sequence
  Description of Artificial Sequence: Synthetic polypeptide
QVQLVQSGAEVKKPGSSVKVSCKASGGTFSSYAISWVRQAPGQGLEWMGGISPIFGTANYAQKFQGRVTITADRSTSTAYMELSSLRSEDTAVYYCARGPGYDPSSLRGFDVWGQGTLVTVSS

SEQ ID NO: 528 - protein, 110 aa, Artificial Sequence
  Description of Artificial Sequence: Synthetic polypeptide
SYELTQPPSVSKDLRQTATLTCTGNSNNVGNQGAAWLQQHQGHPPKLLFYKNNNRPSGISERLSASRSGNTASLTITGLQPEDEADYYCSAWDSSLSDWVFGGGTKLTVL

SEQ ID NO: 529 - protein, 117 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTNTAYMELSSLRSEDTAVYYCARGEEAYYDLWGQGTLVTVSS

SEQ ID NO: 530 - protein, 107 aa, Artificial Sequence
  Description of Artificial Sequence: Synthetic polypeptide
EIVLTQSPGTLSLSPGERATLSCWASQSVSSFLAWYQHKPGQVPRLLIYDASNRATGIPARFSGSGSGTHFTLTISSLEPEDFAVYYCQQRFNWPPTFGQGTKVESK

SEQ ID NO: 531 - protein, 122 aa, Artificial Sequence
  Description of Artificial Sequence: Synthetic polypeptide
QVQLVQSGAEVKKPGSSVKVSCKASGGTFSSYAISWVRQAPGQGLEWMGGITPMFGTANYAQKFQGRVTITADKSTSTAYMELSSLRSEDTAVYYCARGTSYLPGRSGFDVWGQGTLVTVSS

SEQ ID NO: 532 - protein, 107 aa, Artificial Sequence
  Description of Artificial Sequence: Synthetic polypeptide
QPGLTQPPSVSVSPGQTARITCSADALPKQYAYWYQQRPGQAPVLLIYKDTERPPGIPERFSGSSSGTTVTLTISGVQAEDEADYYCQSADASENSVFGGGTKVTVL

SEQ ID NO: 533 - protein, 122 aa, Artificial Sequence
  Description of Artificial Sequence: Synthetic polypeptide
QVQLVQSGAEVKKPGSSVKVSCKASGVTFRSYAISWVRQAPGQGLEWMGGISAMFGTANYAQKFQGRVTITADKSTNTAYMELSSLRSEDTAVYYCARGRGYDPSVGGFDVWGQGTLVTVSS

SEQ ID NO: 534 - protein, 110 aa, Artificial Sequence
  Description of Artificial Sequence: Synthetic polypeptide
NFMLTQPHSVSESPGKTVSISCTGSSGSIASNYVQWYQQRPGSAPATVIYEDNQRPSGVPDRFSGSIDSSSNSASLTISGLKTEDEADYYCQSYDTSNLVFGVGTKLTVL

SEQ ID NO: 535 - protein, 127 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADDSTSTAYMELSSLRSEDTAVYYCARDSTPSVTSSLYRIPAFDVWGQGTLVTVSS

SEQ ID NO: 536 - protein, 112 aa, Artificial Sequence
  Description of Artificial Sequence: Synthetic polypeptide
LPVLTQSSSASASLGSSVKLTCSLTNGPSNYIIAWHQQQPEKGPRYLMKLNSDGSHSKGDGIPDRFSGSSSGAERYLTISNLKSEDEADYYCETWDSNTHVVFGGGTKLTVL

SEQ ID NO: 537 - protein, 122 aa, Artificial Sequence
  Description of Artificial Sequence: Synthetic polypeptide
QVQLVQSGAEVKKPGSSVKVSCKASGGTFSSYAISWVRQAPGQGLEWMGGITPMFGTANYAQKFQGRVTITADKSTSTTYMELSSLRSEDTAVYYCARGPGYYPDSNNYDLWGQGTLVTVSS

SEQ ID NO: 538 - protein, 108 aa, Artificial Sequence
  Description of Artificial Sequence: Synthetic polypeptide
ETTLTQSPGTLSLSPGERATLSCRASQSVSSSYLAWYQQKPGQAPRLLIYGASSRATGIPDRFSGSGSGTDFTLTISRLEPEDFATYYCQQVNSFPRTFGQGTKLEMK

SEQ ID NO: 539 - protein, 122 aa, Artificial Sequence
  Description of Artificial Sequence: Synthetic polypeptide
QVQLVQSGAEVKKPGSSVKVSCKASGVTFSSYAISWVRQAPGQGLEWMGGISPMFGTANYAQKFQGRVTITADQSTNTAYMELSSLRSEDTAVYYCARGGTYSPGGTYFDVWGQGTLVTVSS

SEQ ID NO: 540 - protein, 110 aa, Artificial Sequence
  Description of Artificial Sequence: Synthetic polypeptide
QPVLTQPPSASATPGQTVTISCSGSSSNIGVSFVYWYQQFPGTAPKLLIYRDDMRQSGVPDRFSGFKSGSSASLTISGLQSEDEATYYCSAWDESLSSVLFGGGTKVTVL

SEQ ID NO: 541 - DNA, 351 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggaggtacttttagctcatacgccattagctgggtgcgacaggctcctggtcagggcctcgaatggatgggcggcattatcacaatctttggtactgcaaattatgcccagaaatttcagggtagagtcacaattaccgcagacaaaagtacctcaaccgcatacatggaactgagtagcctgcgttccgaagatacagctgtgtattactgtgcgcgcggtgctacaggtttctacgacgtttggggccaggggaccttagtcactgtgtctagc

SEQ ID NO: 542 - DNA, 331 bp, Artificial Sequence
  Description of Artificial Sequence: Synthetic polynucleotide
ctgcctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggtccggtattcggcggagggaccaagctgaccgtcctag

SEQ ID NO: 543 - DNA, 369 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggagttactttcagctcatacgccattagctgggtgcgacaggctcctggtcagggcctcgaatggatgggcggcattagccctatcttcggcactgcaaattatgcccagaaatttcagggtagagtcacaattaccgcagatgaaagcacgtcaactgcatacatggaactgagtagcctgcgttccgaagatacagctgtgtattactgtgcgcgcggtcgtgagtactacgctagtaatggtgacagtttcgatgtttggggccaggggaccttagtcactgtgtctagc

SEQ ID NO: 544 - DNA, 328 bp, Artificial Sequence
  Description of Artificial Sequence: Synthetic polynucleotide
cagcctgtgctgactcagccaccctcggtgtcagtggccccaggaaagacggccagcatttcctgtgagggaaacaacattgcgactaaaagtgtgcactggtaccagcagaagtcaggccacgcccctgtggtggtcgtctatcatgatagcgaccggccctcaggggtccctgaccgattctctggctccaagtctggcacctcagcctccctggccatcagtgggctccggtccgaggatgaggctgattattactgtgcagcatgggatgacagcctgagtggtccttgggtgttcggcggagggaccaagctgaccgtcctag

SEQ ID NO: 545 - DNA, 369 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggaggtacctttagttcatacgccattagctgggtgcgacaggctcctggtcagggcctcgaatggatgggcggcattagcgcaatcttcggcactgcaaattatgcccagaaatttcagggtagagtcacaattaccgcagatgagagcacgcgcaccgcatacatggaactgagtagcctgcgttccgaagatacagctgtgtattactgtgcgcgcggtagtggttactacgttgctgctagtggtgctttcgacgtgtggggccaggggaccttagtcactgtgtctagc

SEQ ID NO: 546 - DNA, 331 bp, Artificial Sequence
  Description of Artificial Sequence: Synthetic polynucleotide
cagcctgggctgactcagccaccctcggtgtcaaagggcttgagacagaccgccacactcacctgcactgggaacatcaacaatgttggcgaccaaggagcaggttggctgcagcagcaccagggccgccctcccaaactcctgtcgtacaggaatagcaaccggccctcaggtgtctcagagagattctctgcatccaggtcaggaaatacagcctccctgaccattactggactccagcctgaggacgaggctgactattactgctcagcatgggacagcagcctcagtgattgggtgttcggcggagggaccaagctgaccgtcctag

SEQ ID NO: 547 - DNA, 381 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtggcatcttcagctcatacgccattagctgggtgcgacaggctcctggtcagggcctcgaatggatgggcggcatcaccccaatcttcggcactgcaaattatgcccagaaatttcagggtagagtcacaattaccgcagacgaaagcacgcgtaccgcatatatggaactgagtagcctgcgttccgaagatacagctgtgtattactgtgcgcgcgacctgagtcgtgacagtctgaatctgcctggtagtagtcctggttacgatctctggggccaggggaccttagtcactgtgtctagc

SEQ ID NO: 548 - DNA, 322 bp, Artificial Sequence
  Description of Artificial Sequence: Synthetic polynucleotide
gaaacgacactcacgcagtctccaggcaccctgtctttgtctccaggagaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtgtattactgtcagcagtatagtagttctccctacacttttggccaggggaccaaactggagatcaaac

SEQ ID NO: 549 - DNA, 369 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggagtgattttcagctcatacgccattagctgggtgcgacaggctcctggtcagggcctcgaatggatgggcggcattagccctatcttcggcactgcaaattatgcccagaaatttcagggtagagtcacaattaccgcagatgagagcacgtcaaccgcatatatggaactgagtagcctgcgttccgaagatacagctgtgtattactgtgcgcgcagtcgtggttacgctcctggtacaagtttccactacgatgtgtggggccaggggaccttagtcactgtgtctagc

SEQ ID NO: 550 - DNA, 325 bp, Artificial Sequence
  Description of Artificial Sequence: Synthetic polynucleotide
ctgcctgtgctgactcaggcaccctcaatgtcagtggccccaggaaagacggccagtattacctgtgggggagacaacattggaagtaaaagtgtgcactggtaccagcagaagccaggccaggcccctgtgctggtcatgtattatgatagcgaccggccctcagggatccctgagcgattctctggctccaactctgggaacacggccaccctgaccatcagcagggtcgaggccggggatgaggccgactatttctgccagctgtgggatcatactaattctcatgtggtcttcggcggaaggaccaaactgaccgtcctag

SEQ ID NO: 551 - DNA, 363 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtggcacctttagttcttacgccattagctgggtgcgacaggctcctggtcagggcctcgaatggatgggcggcattagcccaatctttggcactgcaaattatgcccagaaatttcagggtagagtcacaattacctcagatgagagtaccagcactgcatacatggaactgagtagcctgcgttccgaagatacagctgtgtattactgtgcgcgcgaccaaggtggtacacgtggtaattacttcgacgtttggggccaggggaccttagtcactgtgtctagc

SEQ ID NO: 552 - DNA, 331 bp, Artificial Sequence
  Description of Artificial Sequence: Synthetic polynucleotide
cagcctgtgctgactcagccaccctcggtgtccaagggcttgagacagaccgccacagtcacctgcactgggaacagcaacaatgttggcaaccaaggagcagcttggctgcagcagcaccagggccaccctcccaaactcctatcctacaggaataacaaccggccctcagggatttcagagagattatctgcatccaggtcaggaaacacagcctccctgaccattgctggactccagcctgaggacgaggctgactattactgctcagcatgggacaacaccgtcagtggttgggtgttcggcggagggaccagggtgaccgtcctag

SEQ ID NO: 553 - DNA, 351 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtggtactttcagttcatacgccattagctgggtgcgacaggctcctggtcagggcctcgaatggatgggcggcattatcacaatcttcggtactgcaaattatgcccagaaatttcagggtagagtcacaattaccgcagatgagagcacgaacaccgcctacatggaactgagtagcctgcgttccgaagatacagctgtgtattactgtgcgcgcggtggtggtggtcgttttgacgtttggggccaggggaccttagtcactgtgtctagc

SEQ ID NO: 554 - DNA, 331 bp, Artificial Sequence
  Description of Artificial Sequence: Synthetic polynucleotide
tcctatgagctgactcagccaccctcagtgtctgggacccccgggcagagggtcaccatctcttgttctggaagcacctccaacatcggaaataatgctctaaactggtaccagaaactcccagggacggcccccaaactcctcatctatagtcttaatcagcgtccctcaggggtccctgaccgattctctggctccaagtctggcacctcagcctccctggccatcagtgggctccagtctgaggatgaggctgattattactgtgaagcatgggatgacagcctgagtggtccggtgttcggcggagggaccaaggtgaccgtcctag

SEQ ID NO: 555 - DNA, 351 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggaggtccatttcgctcatacgccattagctgggtgcgacaggctcctggtcagggcctcgaatggatgggcggcattatcccaatcttcggcactgcaaattatgcccagaaatttcagggtagagtcacaattaccgcagatgaaagtacgtcaactgcatacatggaactgagtagcctgcgttccgaagatacagctgtgtattactgtgcgcgcggtggtgtttacagttttgatgtgtggggccaggggaccttagtcactgtgtctagc

SEQ ID NO: 556 - DNA, 331 bp, Artificial Sequence
  Description of Artificial Sequence: Synthetic polynucleotide
cagtctgggctgactcagccaccctcagcgtctgggacccccgggcagagggtcaccatttcttgttctggaagcggctccaacgtcggaagtaatgttgtaaattggtaccagcatctcccaggaacggcccccaaactcctcatctatcgtaataatcagcggccctcaggggtccctgaccgattctctggctccaagtctggcacctcagcctccctggccatcagtgggctccagtctgaggatgaggctgattattattgtgcagcatgggatgacagactgaatggctttgtctttggtactgggacgaaggtcaccgtcctga

SEQ ID NO: 557 - DNA, 375 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtgttcctttcagttcttacgccattagctgggtgcgacaggctcctggtcagggcctcgaatggatgggcggcatcagcccactgtttggtactgcaaattatgcccagaaatttcagggtagagtcacaattaccgcagaccagagcacgtcaaccgtctacatggaactgagtagcctgcgttccgaagatacagctgtgtattactgtgcgcgcggtctgggtacatacagtcctagtctgtaccctcgtggtatggacgtttggggccaggggaccttagtcactgtgtctagc

SEQ ID NO: 558 - DNA, 331 bp, Artificial Sequence
  Description of Artificial Sequence: Synthetic polynucleotide
ctgcctgtgctgactcagccaccctcagcgtctgggacccccggacagagtgtcaccatctcttgttctggaagcagctccaacatcggcagaaatgatgttaactggtaccagcaattcccgggaagggcccccaaactcctcatctatggtcgtgatgagcggcccttcggggtccctgcccgattctctggctccaagtctggcacctcagcctccctggccatcagtgggctccagtctgaggatgaggctgattattactgtgctgcatgggatgccagtctgatgatctatgtcttcggaactgggaccacggtcaccgtcctgg

SEQ ID NO: 559 - DNA, 366 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggagtgacctttagttcatacgccattagctgggtgcgacaggctcctggtcagggcctcgaatggatgggcggcatcagccctatgttcggcactgcaaattatgcccagaaatttcagggtagagtcacaattaccgcagacgaaagtacgaatactgtctatatggaactgagtagcctgcgttccgaagatacagctgtgtattactgtgcgcgcggtcgtgcttacctgagtgttcgtggtagtttcgacgtgtggggccaggggaccttagtcactgtgtctagc

SEQ ID NO: 560 - DNA, 331 bp, Artificial Sequence
  Description of Artificial Sequence: Synthetic polynucleotide
tcctatgagctgactcagccaccctcagtgtctgggacccccgggcagagggtcaccatctcttgttctggaagcagctccaacatcggaagtaacactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttatgtcttcggaactgggaccaaggtcaccgtcctag

SEQ ID NO: 561 - DNA, 351 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtgtgattttcagttcttacgccattagctgggtgcgacaggctcctggtcagggcctcgaatggatgggcggcatcatcccaatctttggcactgcaaattatgcccagaaatttcagggtagagtcacaattaccgcagataaaagtacgtcaactgcctatatggaactgagtagcctgcgttccgaagatacagctgtgtattactgtgcgcgcggtggtagtggtagtttcgacgtttggggccaggggaccttagtcactgtgtctagc

SEQ ID NO: 562 - DNA, 331 bp, Artificial Sequence
  Description of Artificial Sequence: Synthetic polynucleotide
cagcctgggctgactcagccaccctcagcgtctgggacccccgggcagagggtcaccatctcttgttctggaagcagttccaacctcggaagtaattatgtcttctggtaccagcacctcccaggagcggcccccaaactcctcatctatagaaatagtcagcggccctctggggtccctgaccgattctctggctccaagtctggcacctcagcctccctggccatcagtgggctccagtctgaggatgaggctgattattactgtgcagcatgggatgacagcctgaatggtgtggtattcggcggagggaccaagctgaccgtcctag

SEQ ID NO: 563 - DNA, 375 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggagtgactttcagctcttacgccattagctgggtgcgacaggctcctggtcagggcctcgaatggatgggcggcatcagccctgtgtttggtactgcaaattatgcccagaaatttcagggtagagtcacaattaccgcagatgatagtacgaataccgcctacatggaactgagtagcctgcgttccgaagatacagctgtgtattactgtgcgcgcagtcgtggttacacagttagtagtctggctggtcgttacttcgaccagtggggccaggggaccttagtcactgtgtctagc

SEQ ID NO: 564 - DNA, 325 bp, Artificial Sequence
  Description of Artificial Sequence: Synthetic polynucleotide
gaaacgacactcacgcagtctccaggcaccctgtccttgtctccaggggaaagagcctccctctcctgcaaggccagtgagagtctttgcagcacttgcttggcctggtaccagcagaaacctggccaggctcccaggctcatcgtctatggtgcaaccagcagggccactggcatcccagacaggttcagtggcagtgggtctgggacagacttcactctcaccatcagcagactggagcctgaagattttgcagtgtattactgtcagcagtatggtagctcacctcagacgttcggccaagggaccaaggtggaaatcaaac

SEQ ID NO: 565 - DNA, 351 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggaggcacttttagctcatacgccattagctgggtgcgacaggctcctggtcagggcctcgaatggatgggcggcatcgtgccactgtttggcactgcaaattatgcccagaaatttcagggtagagtcacaattaccgcagacgaaagtaccagcactgcatatatggaactgagtagcctgcgttccgaagatacagctgtgtattactgtgcgcgcggtctgggtctgtactttgacgtgtggggccaggggaccttagtcactgtgtctagc

SEQ ID NO: 566 - DNA, 328 bp, Artificial Sequence
  Description of Artificial Sequence: Synthetic polynucleotide
cagactgtggtgactcaggagccctcactgactgtgtccccaggagagacagtcactctcacctgtgcttccagcactggagcagtcaccagtggttactatccaaactggttccagcagaaacctggacaagcacccagggcactgatttatagtacaagcaacaaacactcctggacccctgcccggttctcaggctccctccttgggggcaaagctgccctgacactgtcaggtgtgcagcctgaggacgaggctgagtattattgtctgctctactatggtggtccttgggtgttcggcggagggaccaagttgaccgtcctgg

SEQ ID NO: 567 - DNA, 366 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtggtactttcagctcatacgccattagctgggtgcgacaggctcctggtcagggcctcgaatggatgggcggcattatcccaatcttcggtactgcaaattatgcccagaaatttcagggtagagtcacaattaccgcagacgaaagcacgaacaccgcctacatggaactgagtagcctgcgttccgaagatacagctgtgtattactgtgcgcgcgttcgtggtggttacggtccttacggtgactttgacgtttggggccaggggaccttagtcactgtgtctagc

SEQ ID NO: 568 - DNA, 331 bp, Artificial Sequence
  Description of Artificial Sequence: Synthetic polynucleotide
cagcctgggctgactcagccaccctcagcgtctgggacccccgggcagagggtcaccatctcttgttctggaagcagctccaacatcggaagtcattctgtgaactggtaccggcagctcccaggaacggccccccaactcctcatctatggtaacagcaatcggccctcaggggtccctgaccgattctctggctccaagtctggcacctcagcgtccctggccatcagtgggctccagtctgaggatgaggctgattatttctgtgcggcatgggatgacggcctgagtggttgggtgttcggcggagggaccaaattgaccgtcctag

SEQ ID NO: 569 - DNA, 369 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtggcccttttagctcatacgccattagctgggtgcgacaggctcctggtcagggcctcgaatggatgggcggcattagcccaatcttcggcactgcaaattatgcccagaaatttcagggtagagtcacaattaccgcagataagagtacgaacaccgcatacatggaactgagtagcctgcgttccgaagatacagctgtgtattactgtgcgcgcggtcgtagttacatcgttagtgttagtcctggttttgacgtgtggggccaggggaccttagtcactgtgtctagc

SEQ ID NO: 570 - DNA, 334 bp, Artificial Sequence
  Description of Artificial Sequence: Synthetic polynucleotide
cagtctgtgctgactcagccaccctccgcgtccgggtctcctggacagtcagtcaccatctcctgcactggaaccagcagtgacgttggtggttataactatgtctcctggtaccaacagtacccaggcaaagcccccaaactcatgatttatgaggtcagtaagcggccctcaggggtccctgatcgtttctctggctccaagtctggcacctcagcctccctggccatcagtgagctccaatctgaggatgaggctgattattactgtgcatcatgggatgacagcctgaatgcttatgtcttcggaagtgggaccaaggtcaccgtcctgg

SEQ ID NO: 571 - DNA, 369 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggaggcattttcagttcatacgccattagctgggtgcgacaggctcctggtcagggcctcgaatggatgggcggcatcagcgcaatctttggtactgcaaattatgcccagaaatttcagggtagagtcacaattaccgcagatgagagtaccagcaccgcatatatggaactgagtagcctgcgttccgaagatacagctgtgtattactgtgcgcgcgacagtggtatcgctagtggttacacagcttacatggattattggggccaggggaccttagtcactgtgtctagc

SEQ ID NO: 572 - DNA, 325 bp, Artificial Sequence
  Description of Artificial Sequence: Synthetic polynucleotide
tcttctgagctgactcaggaccctgctgtgtctgtggccttgggacagacagtcaggatcacatgccaaggagacagcctcagaacctcttacgcaagctggtaccagcagaagccaggccagtcccctgtactggtcatctatcaaagtactaagcggccctcagggatccctgagcgattctctgcctccagctcaggaaacacagcttccctgaccatcactggggctcaggcggaagatgaggctgactattactgtaactcccggggcagcgggggtaacccctatgtcttcggaactgggaccaaggtcaccgtccttg

SEQ ID NO: 573 - DNA, 351 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtggcattttccgttcatacgccattagctgggtgcgacaggctcctggtcagggcctcgaatggatgggcggcattatcccaatgttcggtactgcaaattatgcccagaaatttcagggtagagtcacaattaccgcagatgagagtacgactactgtctatatggaactgagtagcctgcgttccgaagatacagctgtgtattactgtgcgcgcggtgctggtagtacatttgatgtgtggggccaggggaccttagtcactgtgtctagc

SEQ ID NO: 574 - DNA, 331 bp, Artificial Sequence
  Description of Artificial Sequence: Synthetic polynucleotide
cagtctgtgctgactcagccaccctcagcgtctgggacccccgggcagagggtcaccatctcttgttctggaagcagctccaacatcggaagtaatactgtaaactggtaccagcagctcccaggaacggcccccagactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggtcgggtgttcggcggagggaccaagctgaccgtcctag

SEQ ID NO: 575 - DNA, 363 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtggtaccttcagctcatacgccattagctgggtgcgacaggctcctggtcagggcctcgaatggatgggcggcattaaccctatctttggtactgcaaattatgcccagaaatttcagggtagagtcacaattaccgcagatgagagcacgaatactgcctacatggaactgagtagcctgcgttccgaagatacagctgtgtattactgtgcgcgcggtgagagtgcttactacagtcgtaattacgatgtgtggggccaggggaccttagtcactgtgtctagc

SEQ ID NO: 576 - DNA, 331 bp, Artificial Sequence
  Description of Artificial Sequence: Synthetic polynucleotide
tcctatgagctgactcagccaccctcggtgtccaagggcttgagacagaccgccacactcacctgcactgggaacagcagcaatgttggcaaccaaggagcatcttggctgcagcagcaccagggccaccctcccaaactcctatcctacaggaatgacaaccggccctcagggatctcagagagattctctgcatccaggtcaggaaatacagcctccctgaccattactggactccagcctgaggacgaggctgactattactgctcagcatgggacaacagcctcagtgcttgggtgttcggtggagggaccaagctgaccgtcctag

SEQ ID NO: 577 - DNA, 369 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtgtgacttttagctcatacgccattagctgggtgcgacaggctcctggtcagggcctcgaatggatgggcggcatcagcccaatgttcggcactgcaaattatgcccagaaatttcagggtagagtcacaattaccgcagatgagagcacgaataccgcatatatggaactgagtagcctgcgttccgaagatacagctgtgtattactgtgcgcgcggtggtggttactaccctgctggtgttggtcgttatgatgtttggggccaggggaccttagtcactgtgtctagc

SEQ ID NO: 578 - DNA, 340 bp, Artificial Sequence
  Description of Artificial Sequence: Synthetic polynucleotide
gacatcgtgatgacccagtctccagactccctggctgtgtctctgggcgagagggccaccatcaactgcaagtccagccagaatgttttatacagctccaacaataagaataacttagcttggtaccaacaaagaccaggacagcctcctaaagtgctcctttattgggcatctacccgggcatccggggtccctgaccgattcagtggcagcgggtctgggacagatttcactctcaccatcaacagccttcaggctgaagatgtggcactttattactgtcaacaatattatggtaaacccttcactttcggccctgggaccaaagtggagatcaaac

SEQ ID NO: 579 - DNA, 363 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggaggtacctttagctcatacgccattagctgggtgcgacaggctcctggtcagggcctcgaatggatgggcggcattacccctctgttcggcactgcaaattatgcccagaaatttcagggtagagtcacaattaccgcagacgatagtacgtcaactgcatatatggaactgagtagcctgcgttccgaagatacagctgtgtattactgtgcgcgcggtcctacactgtacagtcctcctgtttttgatgtgtggggccaggggaccttagtcactgtgtctagc

SEQ ID NO: 580 - DNA, 331 bp, Artificial Sequence
  Description of Artificial Sequence: Synthetic polynucleotide
cagactgtggtgactcaggagccatcgttctcagtgtcccctggagggacaatcaccctcacttgtggcttgagttctggctcagtctctactactaattatcccagctggtaccagcagaccccaggccgaactccacgcacgctcatctacaacacaaacactcgctcttctggggtccctgatcgcttctctggctccatccttgggaacaaagctgccctcaccatcacgggggcccaggcaggtgatgaatctgattattactgtgttttatatatgggtcgtggcatttatgtcttcggaagtgggaccaaggtctccgtcctgg

SEQ ID NO: 581 - DNA, 369 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggaggcacttttcgctcttacgccattagctgggtgcgacaggctcctggtcagggcctcgaatggatgggcggcatcatgccaatctttggtactgcaaattatgcccagaaatttcagggtagagtcacaattaccgcagacgagagtacgacaaccgtgtacatggaactgagtagcctgcgttccgaagatacagctgtgtattactgtgcgcgcggtgctggtgttagtgctggtcctagttggccttttgacgtttggggccaggggaccttagtcactgtgtctagc

SEQ ID NO: 582 - DNA, 331 bp, Artificial Sequence
  Description of Artificial Sequence: Synthetic polynucleotide
cagcctgggctgactcagccaccctcggtgtccaaggacttgaggcagaccgccacactcacctgcactgggaacagcaacaatgttggcaaacaaggagctacttggctgcagcagcaccagggccaccctcccaaactcctatcctacaggaataacaaccggccctcagggatctcagagagattctctgcatccaggtcaggagacacagcctccctgaccattactggcctccagcctgaggacgaggctgactattactgctcagcatgggacagcagcctcagtgtatgggtgttcggcggagggaccaagctgaccgtcctag

SEQ ID NO: 583 - DNA, 369 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtggtaccttcagctcatacgccattagctgggtgcgacaggctcctggtcagggcctcgaatggatgggcggcattagccctatgtttggtactgcaaattatgcccagaaatttcagggtagagtcacaattaccgcagatgagagcacgtcaaccgtgtacatggaactgagtagcctgcgttccgaagatacagctgtgtattactgtgcgcgcagtcgtggttacaatgttgctgctagtttcggtttcgatgtgtggggccaggggaccttagtcactgtgtctagc

SEQ ID NO: 584 - DNA, 322 bp, Artificial Sequence
  Description of Artificial Sequence: Synthetic polynucleotide
gaaattgtgttgacgcagtctccatccttcctgtctgcatctgtaggagacagagtcaccatcacttgccgggccagtcagtacattgatcgtagcttacactggtaccagcagaaaccagatcagtctccaaagctcctcatcaagtatgcttctcagtccatctcaggggtcccctcgaggttcagtggcagtggatctgggacagatttcagcctcaccatcaatagcctggaaactgaagatgctgcaacctattactgccatcagaccagtagtttgccgtggacattcggccaagggaccacggtggaaatcaaac

SEQ ID NO: 585 - DNA, 363 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtggcccatttagctcatacgccattagctgggtgcgacaggctcctggtcagggcctcgaatggatgggcggcatcatccctatcttcggcactgcaaattatgcccagaaatttcagggtagagtcacaattaccgcagatgaaagtacgtcaaccgcctatatggaactgagtagcctgcgttccgaagatacagctgtgtattactgtgcgcgcggtacagactacagtggttaccgtggttttgacgtttggggccaggggaccttagtcactgtgtctagc

SEQ ID NO: 586 - DNA, 331 bp, Artificial Sequence
  Description of Artificial Sequence: Synthetic polynucleotide
cagactgtggtgactcaggagccatcgttctcagtgtcccctggagggacagtcacactcacctgtgctttgagttctggctcagtctccagttttaactacgccagctggtaccagcagaccccaggccaggcgccacgcacactcatctccaacacaaacactcgctcttctggggtccctgatcgcttctctggctccatccttgggaacaaagctaccctcaccatcacgggggcccaggcagatgatgaatctcattattactgtgcactgtatgtgggtggtggcatttccgtgttcggcggagggaccaagttgaccgtcctag

SEQ ID NO: 587 - DNA, 348 bp, Artificial Sequence
  Description of Artificial Sequence: Synthetic polynucleotide
caggttcaattagtgcagtctggtgctgaagtgaaaaagcccggctcaagtgttaaagtaagctgtaaggcgagcggtgttacttttagctcatacgccattagctgggtgcgacaggctcctggtcagggcctcgaatggatgggcggcatcaccccaatctttggcactgcaaattatgcccagaaatttcagggtagagtcacaattaccgcagatcagagtacgagcactgcatacatggaactgagtagcctgcgttccgaagatacagctgtgtattactgtgcgcgcggtggtggtgttttcgacgtttggggccaggggaccttagtcactgtgtctagc

SEQ ID NO: 588 - DNA, 331 bp, Artificial Sequence
  Description of Artificial Sequence: Synthetic polynucleotide
tcctatgagctgactcagccaccctcggtgtctggagccccccgacagagggtcaccatctcctgttctggaagcagctccaacatcggaaataatgctgtaaactggtaccagcagctcccaggaaaggctcccaaactcctcatctattatgatgatatgctgccctcaggggtctctgaccgattctctggctccaagtctggctcctcagcctccctggccatcagtgggctccagtctgaggatgaggctgactattattgtgcagcatgggatgacagcctgagcggtccggttttcggcggagggaccaacctgaccgtcctag

SEQ ID NO: 589 - DNA, 366 bp, Artificial Sequence; identical to SEQ ID NO: 413
  Description of Artificial Sequence: Synthetic polynucleotide

SEQ ID NO: 590 - DNA, 331 bp, Artificial Sequence; identical to SEQ ID NO: 414
  Description of Artificial Sequence: Synthetic polynucleotide

SEQ ID NO: 591 - DNA, 363 bp, Artificial Sequence; identical to SEQ ID NO: 417
  Description of Artificial Sequence: Synthetic polynucleotide

SEQ ID NO: 592 - DNA, 334 bp, Artificial Sequence; identical to SEQ ID NO: 418
  Description of Artificial Sequence: Synthetic polynucleotide

SEQ ID NO: 593 - DNA, 375 bp, Artificial Sequence; identical to SEQ ID NO: 425
  Description of Artificial Sequence: Synthetic polynucleotide

SEQ ID NO: 594 - DNA, 331 bp, Artificial Sequence; identical to SEQ ID NO: 426
  Description of Artificial Sequence: Synthetic polynucleotide

SEQ ID NO: 595 - DNA, 369 bp, Artificial Sequence; identical to SEQ ID NO: 427
  Description of Artificial Sequence: Synthetic polynucleotide

SEQ ID NO: 596 - DNA, 346 bp, Artificial Sequence; identical to SEQ ID NO: 428
  Description of Artificial Sequence: Synthetic polynucleotide

SEQ ID NO: 597 - DNA, 375 bp, Artificial Sequence; identical to SEQ ID NO: 433
  Description of Artificial Sequence: Synthetic polynucleotide

SEQ ID NO: 598 - DNA, 331 bp, Artificial Sequence; identical to SEQ ID NO: 434
  Description of Artificial Sequence: Synthetic polynucleotide

SEQ ID NO: 599 - DNA, 366 bp, Artificial Sequence; identical to SEQ ID NO: 451
  Description of Artificial Sequence: Synthetic polynucleotide

SEQ ID NO: 600 - DNA, 322 bp, Artificial Sequence; identical to SEQ ID NO: 452
  Description of Artificial Sequence: Synthetic polynucleotide

SEQ ID NO: 601 - protein, 117 aa, Artificial Sequence
  Description of Artificial Sequence: Synthetic polypeptide
QVQLVQSGAEVKKPGSSVKVSCKASGGTFSSYAISWVRQAPGQGLEWMGGIITIFGTANYAQKFQGRVTITADKSTSTAYMELSSLRSEDTAVYYCARGATGFYDVWGQGTLVTVSS

SEQ ID NO: 602 - protein, 110 aa, Artificial Sequence
  Description of Artificial Sequence: Synthetic polypeptide
LPVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGPVFGGGTKLTVL

SEQ ID NO: 603 - protein, 123 aa, Artificial Sequence
  Description of Artificial Sequence: Synthetic polypeptide
QVQLVQSGAEVKKPGSSVKVSCKASGVTFSSYAISWVRQAPGQGLEWMGGISPIFGTANYAQKFQGRVTITADESTSTAYMELSSLRSEDTAVYYCARGREYYASNGDSFDVWGQGTLVTVSS

SEQ ID NO: 604 - protein, 109 aa, Artificial Sequence
  Description of Artificial Sequence: Synthetic polypeptide
QPVLTQPPSVSVAPGKTASISCEGNNIATKSVHWYQQKSGHAPVVVVYHDSDRPSGVPDRFSGSKSGTSASLAISGLRSEDEADYYCAAWDDSLSGPWVFGGGTKLTVL

SEQ ID NO: 605 - protein, 123 aa, Artificial Sequence
  Description of Artificial Sequence: Synthetic polypeptide
QVQLVQSGAEVKKPGSSVKVSCKASGGTFSSYAISWVRQAPGQGLEWMGGISAIFGTANYAQKFQGRVTITADESTRTAYMELSSLRSEDTAVYYCARGSGYYVAASGAFDVWGQGTLVTVSS

SEQ ID NO: 606 - protein, 110 aa, Artificial Sequence
  Description of Artificial Sequence: Synthetic polypeptide
QPGLTQPPSVSKGLRQTATLTCTGNINNVGDQGAGWLQQHQGRPPKLLSYRNSNRPSGVSERFSASRSGNTASLTITGLQPEDEADYYCSAWDSSLSDWVFGGGTKLTVL

SEQ ID NO: 607 - protein, 127 aa, Artificial Sequence
  Description of Artificial Sequence: Synthetic polypeptide
QVQLVQSGAEVKKPGSSVKVSCKASGGIFSSYAISWVRQAPGQGLEWMGGITPIFGTANYAQKFQGRVTITADESTRTAYMELSSLRSEDTAVYYCARDLSRDSLNLPGSSPGYDLWGQGTLVTVSS

SEQ ID NO: 608 - protein, 107 aa, Artificial Sequence
  Description of Artificial Sequence: Synthetic polypeptide
ETTLTQSPGTLSLSPGERATLSCRASQSVSSNLAWYQQKPGQAPRLLIYGASTRATGIPARFSGSGSGTEFTLTISSLQSEDFAVYYCQQYSSSPYTFGQGTKLEIK

SEQ ID NO: 609 - protein, 123 aa, Artificial Sequence
  Description of Artificial Sequence: Synthetic polypeptide
QVQLVQSGAEVKKPGSSVKVSCKASGVIFSSYAISWVRQAPGQGLEWMGGISPIFGTANYAQKFQGRVTITADESTSTAYMELSSLRSEDTAVYYCARSRGYAPGTSFHYDVWGQGTLVTVSS

SEQ ID NO: 610 - protein, 108 aa, Artificial Sequence
  Description of Artificial Sequence: Synthetic polypeptide
LPVLTQAPSMSVAPGKTASITCGGDNIGSKSVHWYQQKPGQAPVLVMYYDSDRPSGIPERFSGSNSGNTATLTISRVEAGDEADYFCQLWDHTNSHVVFGGRTKLTVL

SEQ ID NO: 611 - protein, 121 aa, Artificial Sequence
  Description of Artificial Sequence: Synthetic polypeptide
QVQLVQSGAEVKKPGSSVKVSCKASGGTFSSYAISWVRQAPGQGLEWMGGISPIFGTANYAQKFQGRVTITSDESTSTAYMELSSLRSEDTAVYYCARDQGGTRGNYFDVWGQGTLVTVSS

SEQ ID NO: 612 - protein, 110 aa, Artificial Sequence
  Description of Artificial Sequence: Synthetic polypeptide
QPVLTQPPSVSKGLRQTATVTCTGNSNNVGNQGAAWLQQHQGHPPKLLSYRNNNRPSGISERLSASRSGNTASLTIAGLQPEDEADYYCSAWDNTVSGWVFGGGTRVTVL

SEQ ID NO: 613 - protein, 117 aa, Artificial Sequence
  Description of Artificial Sequence: Synthetic polypeptide
QVQLVQSGAEVKKPGSSVKVSCKASGGTFSSYAISWVRQAPGQGLEWMGGIITIFGTANYAQKFQGRVTITADESTNTAYMELSSLRSEDTAVYYCARGGGGRFDVWGQGTLVTVSS

SEQ ID NO: 614 - protein, 110 aa, Artificial Sequence
  Description of Artificial Sequence: Synthetic polypeptide
SYELTQPPSVSGTPGQRVTISCSGSTSNIGNNALNWYQKLPGTAPKLLIYSLNQRPSGVPDRFSGSKSGTSASLAISGLQSEDEADYYCEAWDDSLSGPVFGGGTKVTVL

SEQ ID NO: 615 - protein, 117 aa, Artificial Sequence
  Description of Artificial Sequence: Synthetic polypeptide
QVQLVQSGAEVKKPGSSVKVSCKASGGPFRSYAISWVRQAPGQGLEWMGGIIPIFGTANYAQKFQGRVTITADESTSTAYMELSSLRSEDTAVYYCARGGVYSFDVWGQGTLVTVSS

SEQ ID NO: 616 - protein, 110 aa, Artificial Sequence
  Description of Artificial Sequence: Synthetic polypeptide
QSGLTQPPSASGTPGQRVTISCSGSGSNVGSNVVNWYQHLPGTAPKLLIYRNNQRPSGVPDRFSGSKSGTSASLAISGLQSEDEADYYCAAWDDRLNGFVFGTGTKVTVL

SEQ ID NO: 617 - protein, 125 aa, Artificial Sequence
  Description of Artificial Sequence: Synthetic polypeptide
QVQLVQSGAEVKKPGSSVKVSCKASGVPFSSYAISWVRQAPGQGLEWMGGISPLFGTANYAQKFQGRVTITADQSTSTVYMELSSLRSEDTAVYYCARGLGTYSPSLYPRGMDVWGQGTLVTVSS

SEQ ID NO: 618 - protein, 110 aa, Artificial Sequence
  Description of Artificial Sequence: Synthetic polypeptide
LPVLTQPPSASGTPGQSVTISCSGSSSNIGRNDVNWYQQFPGRAPKLLIYGRDERPFGVPARFSGSKSGTSASLAISGLQSEDEADYYCAAWDASLMIYVFGTGTTVTVL

SEQ ID NO: 619 - protein, 122 aa, Artificial Sequence
  Description of Artificial Sequence: Synthetic polypeptide
QVQLVQSGAEVKKPGSSVKVSCKASGVTFSSYAISWVRQAPGQGLEWMGGISPMFGTANYAQKFQGRVTITADESTNTVYMELSSLRSEDTAVYYCARGRAYLSVRGSFDVWGQGTLVTVSS

SEQ ID NO: 620 - protein, 110 aa, Artificial Sequence
  Description of Artificial Sequence: Synthetic polypeptide
SYELTQPPSVSGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKVTVL

SEQ ID NO: 621 - protein, 117 aa, Artificial Sequence
  Description of Artificial Sequence: Synthetic polypeptide
QVQLVQSGAEVKKPGSSVKVSCKASGVIFSSYAISWVRQAPGQGLEWMGGIIPIFGTANYAQKFQGRVTITADKSTSTAYMELSSLRSEDTAVYYCARGGSGSFDVWGQGTLVTVSS

SEQ ID NO: 622 - protein, 110 aa, Artificial Sequence
  Description of Artificial Sequence: Synthetic polypeptide
QPGLTQPPSASGTPGQRVTISCSGSSSNLGSNYVFWYQHLPGAAPKLLIYRNSQRPSGVPDRFSGSKSGTSASLAISGLQSEDEADYYCAAWDDSLNGVVFGGGTKLTVL

SEQ ID NO: 623 - protein, 125 aa, Artificial Sequence
  Description of Artificial Sequence: Synthetic polypeptide
QVQLVQSGAEVKKPGSSVKVSCKASGVTFSSYAISWVRQAPGQGLEWMGGISPVFGTANYAQKFQGRVTITADDSTNTAYMELSSLRSEDTAVYYCARSRGYTVSSLAGRYFDQWGQGTLVTVSS

SEQ ID NO: 624 - protein, 108 aa, Artificial Sequence
  Description of Artificial Sequence: Synthetic polypeptide
ETTLTQSPGTLSLSPGERASLSCKASESLCSTCLAWYQQKPGQAPRLIVYGATSRATGIPDRFSGSGSGTDFTLTISRLEPEDFAVYYCQQYGSSPQTFGQGTKVEIK

SEQ ID NO: 625 - protein, 117 aa, Artificial Sequence
  Description of Artificial Sequence: Synthetic polypeptide
QVQLVQSGAEVKKPGSSVKVSCKASGGTFSSYAISWVRQAPGQGLEWMGGIVPLFGTANYAQKFQGRVTITADESTSTAYMELSSLRSEDTAVYYCARGLGLYFDVWGQGTLVTVSS

SEQ ID NO: 626 - protein, 109 aa, Artificial Sequence
  Description of Artificial Sequence: Synthetic polypeptide
QTVVTQEPSLTVSPGETVTLTCASSTGAVTSGYYPNWFQQKPGQAPRALIYSTSNKHSWTPARFSGSLLGGKAALTLSGVQPEDEAEYYCLLYYGGPWVFGGGTKLTVL

SEQ ID NO: 627 - protein, 122 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTNTAYMELSSLRSEDTAVYYCARVRGGYGPYGDFDVWGQGTLVTVSS

SEQ ID NO: 628 - protein, 110 aa, Artificial Sequence
  Description of Artificial Sequence: Synthetic polypeptide
QPGLTQPPSASGTPGQRVTISCSGSSSNIGSHSVNWYRQLPGTAPQLLIYGNSNRPSGVPDRFSGSKSGTSASLAISGLQSEDEADYFCAAWDDGLSGWVFGGGTKLTVL

SEQ ID NO: 629 - protein, 123 aa, Artificial Sequence
  Description of Artificial Sequence: Synthetic polypeptide
QVQLVQSGAEVKKPGSSVKVSCKASGGPFSSYAISWVRQAPGQGLEWMGGISPIFGTANYAQKFQGRVTITADKSTNTAYMELSSLRSEDTAVYYCARGRSYIVSVSPGFDVWGQGTLVTVSS

SEQ ID NO: 630 - protein, 111 aa, Artificial Sequence
  Description of Artificial Sequence: Synthetic polypeptide
QSVLTQPPSASGSPGQSVTISCTGTSSDVGGYNYVSWYQQYPGKAPKLMIYEVSKRPSGVPDRFSGSKSGTSASLAISELQSEDEADYYCASWDDSLNAYVFGSGTKVTVL

SEQ ID NO: 631 - protein, 123 aa, Artificial Sequence
  Description of Artificial Sequence: Synthetic polypeptide
QVQLVQSGAEVKKPGSSVKVSCKASGGIFSSYAISWVRQAPGQGLEWMGGISAIFGTANYAQKFQGRVTITADESTSTAYMELSSLRSEDTAVYYCARDSGIASGYTAYMDYWGQGTLVTVSS

SEQ ID NO: 632 - protein, 108 aa, Artificial Sequence
  Description of Artificial Sequence: Synthetic polypeptide
SSELTQDPAVSVALGQTVRITCQGDSLRTSYASWYQQKPGQSPVLVIYQSTKRPSGIPERFSASSSGNTASLTITGAQAEDEADYYCNSRGSGGNPYVFGTGTKVTVL

SEQ ID NO: 633 - protein, 117 aa, Artificial Sequence
  Description of Artificial Sequence: Synthetic polypeptide
QVQLVQSGAEVKKPGSSVKVSCKASGGIFRSYAISWVRQAPGQGLEWMGGIIPMFGTANYAQKFQGRVTITADESTTTVYMELSSLRSEDTAVYYCARGAGSTFDVWGQGTLVTVSS

SEQ ID NO: 634 - protein, 110 aa, Artificial Sequence
  Description of Artificial Sequence: Synthetic polypeptide
QSVLTQPPSASGTPGQRVTISCSGSSSNIGSNTVNWYQQLPGTAPRLLIYSNNQRPSGVPDRFSGSKSGTSASLAISGLQSEDEADYYCAAWDDSLNGRVFGGGTKLTVL

SEQ ID NO: 635 - protein, 121 aa, Artificial Sequence
  Description of Artificial Sequence: Synthetic polypeptide
QVQLVQSGAEVKKPGSSVKVSCKASGGTFSSYAISWVRQAPGQGLEWMGGINPIFGTANYAQKFQGRVTITADESTNTAYMELSSLRSEDTAVYYCARGESAYYSRNYDVWGQGTLVTVSS

SEQ ID NO: 636 - protein, 110 aa, Artificial Sequence
  Description of Artificial Sequence: Synthetic polypeptide
SYELTQPPSVSKGLRQTATLTCTGNSSNVGNQGASWLQQHQGHPPKLLSYRNDNRPSGISERFSASRSGNTASLTITGLQPEDEADYYCSAWDNSLSAWVFGGGTKLTVL

SEQ ID NO: 637 - protein, 123 aa, Artificial Sequence
  Description of Artificial Sequence: Synthetic polypeptide
QVQLVQSGAEVKKPGSSVKVSCKASGVTFSSYAISWVRQAPGQGLEWMGGISPMFGTANYAQKFQGRVTITADESTNTAYMELSSLRSEDTAVYYCARGGGYYPAGVGRYDVWGQGTLVTVSS

SEQ ID NO: 638 - protein, 113 aa, Artificial Sequence
  Description of Artificial Sequence: Synthetic polypeptide
DIVMTQSPDSLAVSLGERATINCKSSQNVLYSSNNKNNLAWYQQRPGQPPKVLLYWASTRASGVPDRFSGSGSGTDFTLTINSLQAEDVALYYCQQYYGKPFTFGPGTKVEIK

SEQ ID NO: 639 - protein, 121 aa, Artificial Sequence
  Description of Artificial Sequence: Synthetic polypeptide
QVQLVQSGAEVKKPGSSVKVSCKASGGTFSSYAISWVRQAPGQGLEWMGGITPLFGTANYAQKFQGRVTITADDSTSTAYMELSSLRSEDTAVYYCARGPTLYSPPVFDVWGQGTLVTVSS

SEQ ID NO: 640 - protein, 110 aa, Artificial Sequence
  Description of Artificial Sequence: Synthetic polypeptide
QTVVTQEPSFSVSPGGTITLTCGLSSGSVSTTNYPSWYQQTPGRTPRTLIYNTNTRSSGVPDRFSGSILGNKAALTITGAQAGDESDYYCVLYMGRGIYVFGSGTKVSVL

SEQ ID NO: 641 - protein, 123 aa, Artificial Sequence
  Description of Artificial Sequence: Synthetic polypeptide
QVQLVQSGAEVKKPGSSVKVSCKASGGTFRSYAISWVRQAPGQGLEWMGGIMPIFGTANYAQKFQGRVTITADESTTTVYMELSSLRSEDTAVYYCARGAGVSAGPSWPFDVWGQGTLVTVSS

SEQ ID NO: 642 - protein, 110 aa, Artificial Sequence
  Description of Artificial Sequence: Synthetic polypeptide
QPGLTQPPSVSKDLRQTATLTCTGNSNNVGKQGATWLQQHQGHPPKLLSYRNNNRPSGISERFSASRSGDTASLTITGLQPEDEADYYCSAWDSSLSVWVFGGGTKLTVL

SEQ ID NO: 643 - protein, 123 aa, Artificial Sequence
  Description of Artificial Sequence: Synthetic polypeptide
QVQLVQSGAEVKKPGSSVKVSCKASGGTFSSYAISWVRQAPGQGLEWMGGISPMFGTANYAQKFQGRVTITADESTSTVYMELSSLRSEDTAVYYCARSRGYNVAASFGFDVWGQGTLVTVSS

SEQ ID NO: 644 - protein, 107 aa, Artificial Sequence
  Description of Artificial Sequence: Synthetic polypeptide
EIVLTQSPSFLSASVGDRVTITCRASQYIDRSLHWYQQKPDQSPKLLIKYASQSISGVPSRFSGSGSGTDFSLTINSLETEDAATYYCHQTSSLPWTFGQGTTVEIK

SEQ ID NO: 645 - protein, 121 aa, Artificial Sequence
  Description of Artificial Sequence: Synthetic polypeptide
QVQLVQSGAEVKKPGSSVKVSCKASGGPFSSYAISWVRQAPGQGLEWMGGIIPIFGTANYAQKFQGRVTITADESTSTAYMELSSLRSEDTAVYYCARGTDYSGYRGFDVWGQGTLVTVSS

SEQ ID NO: 646 - protein, 110 aa, Artificial Sequence
  Description of Artificial Sequence: Synthetic polypeptide
QTVVTQEPSFSVSPGGTVTLTCALSSGSVSSFNYASWYQQTPGQAPRTLISNTNTRSSGVPDRFSGSILGNKATLTITGAQADDESHYYCALYVGGGISVFGGGTKLTVL

SEQ ID NO: 647 - protein, 116 aa, Artificial Sequence
  Description of Artificial Sequence: Synthetic polypeptide
QVQLVQSGAEVKKPGSSVKVSCKASGVTFSSYAISWVRQAPGQGLEWMGGITPIFGTANYAQKFQGRVTITADQSTSTAYMELSSLRSEDTAVYYCARGGGVFDVWGQGTLVTVSS

SEQ ID NO: 648 - protein, 110 aa, Artificial Sequence
  Description of Artificial Sequence: Synthetic polypeptide
SYELTQPPSVSGAPRQRVTISCSGSSSNIGNNAVNWYQQLPGKAPKLLIYYDDMLPSGVSDRFSGSKSGSSASLAISGLQSEDEADYYCAAWDDSLSGPVFGGGTNLTVL

SEQ ID NO: 649 - protein, 122 aa, Artificial Sequence; identical to SEQ ID NO: 485
  Description of Artificial Sequence: Synthetic polypeptide

SEQ ID NO: 650 - protein, 110 aa, Artificial Sequence; identical to SEQ ID NO: 486
  Description of Artificial Sequence: Synthetic polypeptide

SEQ ID NO: 651 - protein, 121 aa, Artificial Sequence; identical to SEQ ID NO: 489
  Description of Artificial Sequence: Synthetic polypeptide

SEQ ID NO: 652 - protein, 111 aa, Artificial Sequence; identical to SEQ ID NO: 490
  Description of Artificial Sequence: Synthetic polypeptide

SEQ ID NO: 653 - protein, 125 aa, Artificial Sequence; identical to SEQ ID NO: 497
  Description of Artificial Sequence: Synthetic polypeptide

SEQ ID NO: 654 - protein, 110 aa, Artificial Sequence; identical to SEQ ID NO: 498
  Description of Artificial Sequence: Synthetic polypeptide

SEQ ID NO: 655 - protein, 123 aa, Artificial Sequence; identical to SEQ ID NO: 499
  Description of Artificial Sequence: Synthetic polypeptide

SEQ ID NO: 656 - protein, 115 aa, Artificial Sequence; identical to SEQ ID NO: 500
  Description of Artificial Sequence: Synthetic polypeptide

SEQ ID NO: 657 - protein, 125 aa, Artificial Sequence; identical to SEQ ID NO: 505
  Description of Artificial Sequence: Synthetic polypeptide

SEQ ID NO: 658 - protein, 110 aa, Artificial Sequence; identical to SEQ ID NO: 506
  Description of Artificial Sequence: Synthetic polypeptide

SEQ ID NO: 659 - protein, 122 aa, Artificial Sequence; identical to SEQ ID NO: 523
  Description of Artificial Sequence: Synthetic polypeptide

SEQ ID NO: 660 - protein, 107 aa, Artificial Sequence; identical to SEQ ID NO: 524
  Description of Artificial Sequence: Synthetic polypeptide

SEQ ID NO: 661 - protein, 9 aa, Artificial Sequence
  Description of Artificial Sequence: Synthetic peptide
  MOD_RES (4)..(5): Any naturally occurring amino acid
  MOD_RES (8)..(8): Any naturally occurring amino acid
CARXXGYXP

SEQ ID NO: 662 - protein, 8 aa, Artificial Sequence
  Description of Artificial Sequence: Synthetic peptide
  MOD_RES (4)..(6): Any naturally occurring amino acid
CARXXXYY

SEQ ID NO: 663 - DNA, 21 bp, Artificial Sequence
  Description of Artificial Sequence: Synthetic oligonucleotide
tggacaagggcttgagtggat

SEQ ID NO: 664 - DNA, 22 bp, Artificial Sequence
  Description of Artificial Sequence: Synthetic oligonucleotide
ccctggaacttctgtgcgtagt

SEQ ID NO: 665 - DNA, 18 bp, Artificial Sequence
  Description of Artificial Sequence: Synthetic oligonucleotide
cctatccttggtatagca

SEQ ID NO: 666 - DNA, 21 bp, Artificial Sequence
  Description of Artificial Sequence: Synthetic oligonucleotide
tggacaagggcttgagtggat

SEQ ID NO: 667 - DNA, 22 bp, Artificial Sequence
  Description of Artificial Sequence: Synthetic oligonucleotide
ccctggaacttctgtgcgtagt

SEQ ID NO: 668 - DNA, 18 bp, Artificial Sequence
  Description of Artificial Sequence: Synthetic oligonucleotide
ccctatctttggtacagc

SEQ ID NO: 669 - protein, 11 aa, Artificial Sequence
  Description of Artificial Sequence: Synthetic peptide
WGQGTLVTVSS

SEQ ID NO: 670 - protein, 20 aa, Artificial Sequence
  Description of Artificial Sequence: Synthetic peptide
YYYYYGMDVWGQGTTVTVSS

SEQ ID NO: 671 - protein, 14 aa, Artificial Sequence
  Description of Artificial Sequence: Synthetic peptide
FDVWGQGTLVTVSS

SEQ ID NO: 672 - protein, 16 aa, Artificial Sequence
  Description of Artificial Sequence: Synthetic peptide
GGGSGGGSGGGSGGGS

SEQ ID NO: 673 - protein, 8 aa, Artificial Sequence
  Description of Artificial Sequence: Synthetic peptide
IIPIFGTA

SEQ ID NO: 674 - protein, 8 aa, Artificial Sequence
  Description of Artificial Sequence: Synthetic peptide
ISPIFGTA

SEQ ID NO: 675 - protein, 8 aa, Artificial Sequence
  Description of Artificial Sequence: Synthetic peptide
IIPMFGTA

SEQ ID NO: 676 - protein, 8 aa, Artificial Sequence
  Description of Artificial Sequence: Synthetic peptide
IIPIFRTA

SEQ ID NO: 677 - DNA, 354 bp, Artificial Sequence
  Description of Artificial Sequence: Synthetic polynucleotide
caggtgcagctggtgcagtctgggggaggcgtggtccaacctgggaggtccctgagactctcctgtgtagcctctgagttcaccttcaatacttatggcatgcactgggtccgccaggctccaggcaagggactggagtgggtggcagctatttcatatgatggaactaagaaattttatgcagactccctgaagggccgattcaccatctccagagacaattccaagaacacgttgtatctccaaatgaacagcctgagatctgaggacacggccgtgtattactgtgcgagaagtggtgactccgatgcttttgatatctggggccaagggacaatggtcaccgtctcctca

SEQ ID NO: 678 - protein, 118 aa, Artificial Sequence
  Description of Artificial Sequence: Synthetic polypeptide
QVQLVQSGGGVVQPGRSLRLSCVASEFTFNTYGMHWVRQAPGKGLEWVAAISYDGTKKFYADSLKGRFTISRDNSKNTLYLQMNSLRSEDTAVYYCARSGDSDAFDIWGQGTMVTVSS

SEQ ID NO: 679 - DNA, 321 bp, Artificial Sequence
  Description of Artificial Sequence: Synthetic polynucleotide
tcctatgagctgactcagccaccctcagtgtccgtgtccccaggacagacagccaccatcacctgctctggagatgaattgggggataaatttgctttctggtatcaacaaaagccaggccagtcccctgtgctggtcatctatcaagatagtaagaggccctcagggatccctgagcgattctctggctccaactctgggaacacagccactctgaccatcagcgggacccaggctctggatgaggctgactattactgtcaggcgtgggacagcaacagttatgtcttcggaactgggaccaaggtcaccgtcctaggt

SEQ ID NO: 680 - protein, 106 aa, Artificial Sequence
  Description of Artificial Sequence: Synthetic polypeptide
SYELTQPPSVSVSPGQTATITCSGDELGDKFAFWYQQKPGQSPVLVIYQDSKRPSGIPERFSGSNSGNTATLTISGTQALDEADYYCQAWDSNSYVFGTGTKVTVL

SEQ ID NO: 681 - DNA, 360 bp, Artificial Sequence
  Description of Artificial Sequence: Synthetic polynucleotide
gaggtgcagctggtgcagtctggggctgaggtgaaggagcctgggtcctcggtgaaggtctcctgcaaggcttctgggggcaccttcggcagttatgctatcaactgggtgcgacaggcccctggacaaaggcttgagtggatgggatggatcgacgctgccaatggtaacacaaaatattcacagaagttccagggcagagtcaccattaccggagacacatccgcgagcacagcctacatggaactgagcagcctgagatctgaagacacggctgtgtattactgtgcgagagataggtggatgactacgcgggcttttgatatctggggccaagggacaatggtcaccgtctcttca

SEQ ID NO: 682 - protein, 120 aa, Artificial Sequence
  Description of Artificial Sequence: Synthetic polypeptide
EVQLVQSGAEVKEPGSSVKVSCKASGGTFGSYAINWVRQAPGQRLEWMGWIDAANGNTKYSQKFQGRVTITGDTSASTAYMELSSLRSEDTAVYYCARDRWMTTRAFDIWGQGTMVTVSS

SEQ ID NO: 683 - DNA, 333 bp, Artificial Sequence
  Description of Artificial Sequence: Synthetic polynucleotide
cagcctgtgctgactcagccaccctcagcgtctgggacccccgggcagagggtcaccatctcttgttctggaagcagctccaacatcggaagtaattatgttttctggtaccagcagctcccagggatggcccccaaactcctcatctctaggaataatcagcggccctcaggggtccctgaccgattctctggctccaagtctggcacctcagcctccctggccatcagtgggccccagtctgaggatgaggctgattattactgtgcagcatgggatgacagcctgcgtggtcccgtgttcggcggagggaccagggtgaccgtcctaggt

SEQ ID NO: 684 - protein, 110 aa, Artificial Sequence
  Description of Artificial Sequence: Synthetic polypeptide
QPVLTQPPSASGTPGQRVTISCSGSSSNIGSNYVFWYQQLPGMAPKLLISRNNQRPSGVPDRFSGSKSGTSASLAISGPQSEDEADYYCAAWDDSLRGPVFGGGTRVTVL

SEQ ID NO: 685 - DNA, 369 bp, Artificial Sequence
  Description of Artificial Sequence: Synthetic polynucleotide
caggtgcagctggtgcagtctggggctgaggtgaagaagcctgggtcctcggtgaaggtctcctgcaaggcgtctggaggcactttcagcagctatgcagtcagctgggtgcgacaggcccctggacaaggtcttgagtgggtgggaaggataatccctatttttggtaaggcaaactacgcacagaagttccagggcagagtcacgataaccgcggacaaatccacgagcacagcctatatggaactgagcagcctgagacctgaagacacggccgtatattactgtgcgagagatcaggggatttcggccaatttcaaagatgcttttgatatctggggccaagggaccacggtcaccgtctcctca

SEQ ID NO: 686 - protein, 123 aa, Artificial Sequence
  Description of Artificial Sequence: Synthetic polypeptide
QVQLVQSGAEVKKPGSSVKVSCKASGGTFSSYAVSWVRQAPGQGLEWVGRIIPIFGKANYAQKFQGRVTITADKSTSTAYMELSSLRPEDTAVYYCARDQGISANFKDAFDIWGQGTTVTVSS

SEQ ID NO: 687 - DNA, 321 bp, Artificial Sequence
  Description of Artificial Sequence: Synthetic polynucleotide
gaaacgacactcacgcagtctccagccaccctgtctgtgtctccaggggaaagagccaccctctcctgcagggccagtgagagtgttggcagcaacttagcctggtaccagcagaaacctggccaggctcccagcctcctcatctatggtgcatccaccagggccactggtatcccagacagattcagtggcagtgggtctgggacagacttcactctcaccatcagcagcctgcagtctgaagattttgcagcttattattgtcagcagtataataactggccactcaccttcggccctgggaccaaagtggaaatcaaa

SEQ ID NO: 688 - protein, 107 aa, Artificial Sequence
  Description of Artificial Sequence: Synthetic polypeptide
ETTLTQSPATLSVSPGERATLSCRASESVGSNLAWYQQKPGQAPSLLIYGASTRATGIPDRFSGSGSGTDFTLTISSLQSEDFAAYYCQQYNNWPLTFGPGTKVEIK

SEQ ID NO: 689 - DNA, 375 bp, Artificial Sequence
  Description of Artificial Sequence: Synthetic polynucleotide
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagggtaggatattgtagtagtaccagctgtcacatcggcgcttttgatatctggggccaagggaccacggtcaccgtctcctca

SEQ ID NO: 690 - protein, 125 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARVGYCSSTSCHIGAFDIWGQGTTVTVSS

SEQ ID NO: 691 - DNA, 321 bp, Artificial Sequence
  Description of Artificial Sequence: Synthetic polynucleotide
gaaacgacactcacgcagtctccaggcaccctgtctttgtctccaggggaaagagccaccctctcctgcagggccagtcagagtgttagcagcagcatagcctggtatcagcagaaacctgggcaggctcccaggctcctcatgtttgattcatccaccagggccactggtatcccagacaggttcagtggcagtgggtctgggacagacttcactctcaacatcagcagcctagagcctgaagattttgcagtgtattactgtcagcagtatagtagctcaccttacacttttggccaggggaccaaactggagatcaaa

SEQ ID NO: 692 - protein, 107 aa, Artificial Sequence
  Description of Artificial Sequence: Synthetic polypeptide
ETTLTQSPGTLSLSPGERATLSCRASQSVSSSIAWYQQKPGQAPRLLMFDSSTRATGIPDRFSGSGSGTDFTLNISSLEPEDFAVYYCQQYSSSPYTFGQGTKLEIK

SEQ ID NO: 693 - DNA, 375 bp, Artificial Sequence
  Description of Artificial Sequence: Synthetic polynucleotide
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagcctcatattgtagtactaccagctgcgctagtggtgcttttgatatctggggccaaggcaccctggtcaccgtctcctca

SEQ ID NO: 694 - protein, 125 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARASYCSTTSCASGAFDIWGQGTLVTVSS

SEQ ID NO: 695 - DNA, 339 bp, Artificial Sequence
  Description of Artificial Sequence: Synthetic polynucleotide
gacatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctgcccgggaatccggggtccctgaccgattcagtggcagcgggtctgggacagatttcactctcaccatcagcagcctgcagcctgaagatgtggcaatttattactgtcagcaatattatagtgttccattcactttcggccctgggaccaaagtggagatcaaa

SEQ ID NO: 696 - protein, 113 aa, Artificial Sequence
  Description of Artificial Sequence: Synthetic polypeptide
DIQMTQSPDSLAVSLGERATINCKSSQSVLYSSNNKNYLAWYQQKPGQPPKLLIYWASARESGVPDRFSGSGSGTDFTLTISSLQPEDVAIYYCQQYYSVPFTFGPGTKVEIK

SEQ ID NO: 697 - DNA, 363 bp, Artificial Sequence
  Description of Artificial Sequence: Synthetic polynucleotide
gaggtgcagctggtgcagtctggagctgaggtgaagaagcctggggcctcagtgaaggtttcctgcaaggcttctggatacaccttcaatgtatatgctatcaactgggtgcgacaggcccctggacaagggcttgagtggatgggaaggatcatccctatccttggtatagcaaactacgcacagaagttccagggcagagtcacgattaccgcggacaaatccacgagcacagcctacatggagctgagcagcctgagatctgaggacacggccgtgtattactgtgcgagagattactatggttcgggagctaggggctttgactactggggccagggcaccctggtcaccgtctcctca

SEQ ID NO: 698 - protein, 121 aa, Artificial Sequence
  Description of Artificial Sequence: Synthetic polypeptide
EVQLVQSGAEVKKPGASVKVSCKASGYTFNVYAINWVRQAPGQGLEWMGRIIPILGIANYAQKFQGRVTITADKSTSTAYMELSSLRSEDTAVYYCARDYYGSGARGFDYWGQGTLVTVSS

SEQ ID NO: 699 - DNA, 333 bp, Artificial Sequence
  Description of Artificial Sequence: Synthetic polynucleotide
cagcctgggctgactcagccaccctcggtgtccaagggcttgagacagaccgccacactcacctgcactgggaacagcaacaatgttggcaaccaaggagcagcttggctgcagcagcaccagggccaccctcccaaactcctatcctacacgaataacaaccggccctcagggatctcagagagattatctgcatccaggtcaggaaacacagcctccctggccattactggactccagcctgaggacgaggcagactattactgtgcatcatgggacagcagcctcagtgtttgggtgatcggcggagggaccaagttgaccgtcctaggt

SEQ ID NO: 700 - protein, 110 aa, Artificial Sequence
  Description of Artificial Sequence: Synthetic polypeptide
QPGLTQPPSVSKGLRQTATLTCTGNSNNVGNQGAAWLQQHQGHPPKLLSYTNNNRPSGISERLSASRSGNTASLAITGLQPEDEADYYCASWDSSLSVWVIGGGTKLTVL

SEQ ID NO: 701 - DNA, 378 bp, Artificial Sequence
  Description of Artificial Sequence: Synthetic polynucleotide
gaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtatagcaaactacgcacagaagttccagggcagagtcacgattaccgcggacaaatccacgagcacagcctacatggagctgagcagcctgagatctgaggacacggccgtgtattactgtgcgagctctaattactatggttcagggagttattatccgcgaagtgcttttgatatctggggccaagggaccacggtcaccgtctcctca

SEQ ID NO: 702 - protein, 126 aa, Artificial Sequence
  Description of Artificial Sequence: Synthetic polypeptide
EVQLVQSGAEVKKPGSSVKVSCKASGGTFSSYAISWVRQAPGQGLEWMGGIIPIFGIANYAQKFQGRVTITADKSTSTAYMELSSLRSEDTAVYYCASSNYYGSGSYYPRSAFDIWGQGTTVTVSS

SEQ ID NO: 703 - DNA, 321 bp, Artificial Sequence
  Description of Artificial Sequence: Synthetic polynucleotide
gaaacgacactcacgcagtctccagccaccctgtctgtgtctccaggggaaagggccatcctctcctgcagggccagtcagagtataagcaatgacttagcctggtaccagcagaaacctggccaggctcccaggctcctcatctatggtgcatccagcagggccactggcatcccagacaggttcagtggcagtgggtctgggacggacttcaccttcaccatcagcagactggagtctgaagattttgcagtgtattactgtcagcagtatggtgtttcacctctcactttcggcggggggaccaaggtggagatcaaa

SEQ ID NO: 704 - protein, 107 aa, Artificial Sequence
  Description of Artificial Sequence: Synthetic polypeptide
ETTLTQSPATLSVSPGERAILSCRASQSISNDLAWYQQKPGQAPRLLIYGASSRATGIPDRFSGSGSGTDFTFTISRLESEDFAVYYCQQYGVSPLTFGGGTKVEIK

SEQ ID NO: 705 - protein, 8 aa, Artificial Sequence
  Description of Artificial Sequence: Synthetic peptide
EFTFNTYG

SEQ ID NO: 706 - protein, 8 aa, Artificial Sequence
  Description of Artificial Sequence: Synthetic peptide
ISYDGTKK

SEQ ID NO: 707 - protein, 11 aa, Artificial Sequence
  Description of Artificial Sequence: Synthetic peptide
ARSGDSDAFDI

SEQ ID NO: 708 - protein, 8 aa, Artificial Sequence
  Description of Artificial Sequence: Synthetic peptide
GGTFGSYA

SEQ ID NO: 709 - protein, 8 aa, Artificial Sequence
  Description of Artificial Sequence: Synthetic peptide
IDAANGNT

SEQ ID NO: 710 - protein, 13 aa, Artificial Sequence
  Description of Artificial Sequence: Synthetic peptide
ARDRWMTTRAFDI

SEQ ID NO: 711 - protein, 8 aa, Artificial Sequence
  Description of Artificial Sequence: Synthetic peptide
GGTFSSYA

SEQ ID NO: 712 - protein, 8 aa, Artificial Sequence
  Description of Artificial Sequence: Synthetic peptide
IIPIFGKA

SEQ ID NO: 713 - protein, 16 aa, Artificial Sequence
  Description of Artificial Sequence: Synthetic peptide
ARDQGISANFKDAFDI

SEQ ID NO: 714 - protein, 8 aa, Artificial Sequence
  Description of Artificial Sequence: Synthetic peptide
GGTFSSYA

SEQ ID NO: 715 - protein, 18 aa, Artificial Sequence
  Description of Artificial Sequence: Synthetic peptide
ARVGYCSSTSCHIGAFDI

SEQ ID NO: 716 - protein, 18 aa, Artificial Sequence
  Description of Artificial Sequence: Synthetic peptide
ARASYCSTTSCASGAFDI

SEQ ID NO: 717 - protein, 8 aa, Artificial Sequence
  Description of Artificial Sequence: Synthetic peptide
GYTFNVYA

SEQ ID NO: 718 - protein, 8 aa, Artificial Sequence
  Description of Artificial Sequence: Synthetic peptide
IIPILGIA

SEQ ID NO: 719 - protein, 14 aa, Artificial Sequence
  Description of Artificial Sequence: Synthetic peptide
ARDYYGSGARGFDY

SEQ ID NO: 720 - protein, 8 aa, Artificial Sequence
  Description of Artificial Sequence: Synthetic peptide
IIPIFGIA

SEQ ID NO: 721 - protein, 19 aa, Artificial Sequence
  Description of Artificial Sequence: Synthetic peptide
ASSNYYGSGSYYPRSAFDI

SEQ ID NO: 722 - protein, 6 aa, Artificial Sequence
  Description of Artificial Sequence: Synthetic peptide
ELGDKF

SEQ ID NO: 723 - protein, 3 aa, Artificial Sequence
  Description of Artificial Sequence: Synthetic peptide
QDS

SEQ ID NO: 724 - protein, 9 aa, Artificial Sequence
  Description of Artificial Sequence: Synthetic peptide
QAWDSNSYV

SEQ ID NO: 725 - protein, 8 aa, Artificial Sequence
  Description of Artificial Sequence: Synthetic peptide
SSNIGSNY

SEQ ID NO: 726 - protein, 3 aa, Artificial Sequence
  Description of Artificial Sequence: Synthetic peptide
RNN

SEQ ID NO: 727 - protein, 11 aa, Artificial Sequence
  Description of Artificial Sequence: Synthetic peptide
AAWDDSLRGPV

SEQ ID NO: 728 - protein, 6 aa, Artificial Sequence
  Description of Artificial Sequence: Synthetic peptide
ESVGSN

SEQ ID NO: 729 - protein, 3 aa, Artificial Sequence
  Description of Artificial Sequence: Synthetic peptide
GAS

SEQ ID NO: 730 - protein, 9 aa, Artificial Sequence
  Description of Artificial Sequence: Synthetic peptide
QQYNNWPLT

SEQ ID NO: 731 - protein, 6 aa, Artificial Sequence
  Description of Artificial Sequence: Synthetic peptide
QSVSSS

SEQ ID NO: 732 - protein, 3 aa, Artificial Sequence
  Description of Artificial Sequence: Synthetic peptide
DSS

SEQ ID NO: 733 - protein, 9 aa, Artificial Sequence
  Description of Artificial Sequence: Synthetic peptide
QQYSSSPYT

SEQ ID NO: 734 - protein, 1255 aa, Middle East respiratory syndrome coronavirus
MFIFLLFLTLTSGSDLDRCTTFDDVQAPNYTQHTSSMRGVYYPDEIFRSDTLYLTQDLFLPFYSNVTGFHTINHTFGNPVIPFKDGIYFAATEKSNVVRGWVFGSTMNNKSQSVIIINNSTNVVIRACNFELCDNPFFAVSKPMGTQTHTMIFDNAFNCTFEYISDAFSLDVSEKSGNFKHLREFVFKNKDGFLYVYKGYQPIDVVRDLPSGFNTLKPIFKLPLGINITNFRAILTAFSPAQDIWGTSAAAYFVGYLKPTTFMLKYDENGTITDAVDCSQNPLAELKCSVKSFEIDKGIYQTSNFRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTPSSKRFQPFQQFGRDVSDFTDSVRDPKTSEILDISPCSFGGVSVITPGTNASSEVAVLYQDVNCTDVSTAIHADQLTPAWRIYSTGNNVFQTQAGCLIGAEHVDTSYECDIPIGAGICASYHTVSLLRSTSQKSIVAYTMSLGADSSIAYSNNTIAIPTNFSISITTEVMPVSMAKTSVDCNMYICGDSTECANLLLQYGSFCTQLNRALSGIAAEQDRNTREVFAQVKQMYKTPTLKYFGGFNFSQILPDPLKPTKRSFIEDLLFNKVTLADAGFMKQYGECLGDINARDLICAQKFNGLTVLPPLLTDDMIAAYTAALVSGTATAGWTFGAGAALQIPFAMQMAYRFNGIGVTQNVLYENQKQIANQFNKAISQIQESLTTTSTALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQAAPHGVVFLHVTYVPSQERNFTTAPAICHEGKAYFPREGVFVFNGTSWFITQRNFFSPQIITTDNTFVSGNCDVVIGIINNTVYDPLQPELDSFKEELDKYFKNHTSPDVDLGDISGINASVVNIQKEIDRLNEVAKNLNESLIDLQELGKYEQYIKWPWYVWLGFIAGLIAIVMVTILLCCMTSCCSCLKGACSCGSCCKFDEDDSEPVLKGVKLHYT

SEQ ID NO: 735 - protein, 8 aa, Artificial Sequence
  Description of Artificial Sequence: Synthetic peptide
IIPIFGTA

SEQ ID NO: 736 - protein, 8 aa, Artificial Sequence
  Description of Artificial Sequence: Synthetic peptide
SNNVGNQG

SEQ ID NO: 737 - protein, 12 aa, Artificial Sequence
  Description of Artificial Sequence: Synthetic peptide
QSVLYSSNNKNY

SEQ ID NO: 738 - protein, 3 aa, Artificial Sequence
  Description of Artificial Sequence: Synthetic peptide
WAS

SEQ ID NO: 739 - protein, 9 aa, Artificial Sequence
  Description of Artificial Sequence: Synthetic peptide
QQYYSVPFT

SEQ ID NO: 740 - protein, 6 aa, Artificial Sequence
  Description of Artificial Sequence: Synthetic peptide
QSISND

SEQ ID NO: 741 - protein, 9 aa, Artificial Sequence
  Description of Artificial Sequence: Synthetic peptide
QQYGVSPLT

SEQ ID NO: 742 - protein, 3 aa, Artificial Sequence
  Description of Artificial Sequence: Synthetic peptide
TNN

SEQ ID NO: 743 - protein, 11 aa, Artificial Sequence
  Description of Artificial Sequence: Synthetic peptide
ASWDSSLSVWV

SEQ ID NO: 744 - protein, 96 aa, Homo sapiens
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYC

SEQ ID NO: 745 - protein, 96 aa, Homo sapiens
QVQLVQSGAEVKKPGSSVKVSCKASGGTFSSYAISWVRQAPGQGLEWMGRIIPILGIANYAQKFQGRVTITADKSTSTAYMELSSLRSEDTAVYYC

SEQ ID NO: 746 - protein, 96 aa, Homo sapiens
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYC

SEQ ID NO: 747 - protein, 96 aa, Homo sapiens
QVQLVQSGAEVKKPGASVKVSCKASGYTFTSYAMHWVRQAPGQRLEWMGWINAGNGNTKYSQKFQGRVTITRDTSASTAYMELSSLRSEDTAVYYC

SEQ ID NO: 748 - protein, 87 aa, Homo sapiens
SYELTQPPSVSVSPGQTASITCSGDKLGDKYACWYQQKPGQSPVLVIYQDSKRPSGIPERFSGSNSGNTATLTISGTQAMDEADYYC

SEQ ID NO: 749 - protein, 89 aa, Homo sapiens
QSVLTQPPSASGTPGQRVTISCSGSSSNIGSNYVYWYQQLPGTAPKLLIYRNNQRPSGVPDRFSGSKSGTSASLAISGLRSEDEADYYC

SEQ ID NO: 750 - protein, 88 aa, Homo sapiens
EIVMTQSPATLSVSPGERATLSCRASQSVSSNLAWYQQKPGQAPRLLIYGASTRATGIPARFSGSGSGTEFTLTISSLQSEDFAVYYC

SEQ ID NO: 751 - protein, 94 aa, Homo sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYC

SEQ ID NO: 752 - protein, 89 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYC

SEQ ID NO: 753 - protein, 89 aa, Homo sapiens
QAGLTQPPSVSKGLRQTATLTCTGNSNNVGNQGAAWLQQHQGHPPKLLSYRNNNRPSGISERLSASRSGNTASLTITGLQPEDEADYYC

SEQ ID NO: 754 - protein, 12 aa, Middle East respiratory syndrome coronavirus
AAALDTVYRPNI

SEQ ID NO: 755 - protein, 12 aa, Middle East respiratory syndrome coronavirus
PAVLDTVYRPNI

SEQ ID NO: 756 - protein, 12 aa, Middle East respiratory syndrome coronavirus
ASALDTVYRPNI

SEQ ID NO: 757 - protein, 12 aa, Middle East respiratory syndrome coronavirus
AVALDTVYRPNI

SEQ ID NO: 758 - protein, 12 aa, Middle East respiratory syndrome coronavirus
AAAFDTVYRPNI

SEQ ID NO: 759 - protein, 12 aa, Middle East respiratory syndrome coronavirus
AAALGTVYRPNI

SEQ ID NO: 760 - protein, 12 aa, Middle East respiratory syndrome coronavirus
AAALDTAYRPNI

SEQ ID NO: 761 - protein, 12 aa, Middle East respiratory syndrome coronavirus
AAALDTVYRPII

SEQ ID NO: 762 - protein, 12 aa, Middle East respiratory syndrome coronavirus
AAALDTVYRSNI

SEQ ID NO: 763 - protein, 12 aa, Middle East respiratory syndrome coronavirus
AAALDTVYGPNI

SEQ ID NO: 764 - protein, 12 aa, Artificial Sequence
  Description of Artificial Sequence: Synthetic peptide
AAALDTVYSPNT

SEQ ID NO: 765 - protein, 12 aa, Middle East respiratory syndrome coronavirus
AAALDTVYTPNI

SEQ ID NO: 766 - protein, 12 aa, Middle East respiratory syndrome coronavirus
AAALDTVYKPNI

SEQ ID NO: 767 - protein, 12 aa, Middle East respiratory syndrome coronavirus
AAAFDAVYRPNI

SEQ ID NO: 768 - protein, 12 aa, Middle East respiratory syndrome coronavirus
AAALDTVYKPNI

SEQ ID NO: 769 - protein, 12 aa, Middle East respiratory syndrome coronavirus
AAAFDTVCRPNI

SEQ ID NO: 770 - protein, 12 aa, Middle East respiratory syndrome coronavirus
AAALDTVHRPNI

SEQ ID NO: 771 - protein, 112 aa, Homo sapiens
QVQLVQSGGGVVQPGRSLRLSCAASGFTFSSYGMHWVRQAPGKGLEWVAVISYDGSKYYADSVKGRFTISRDNSKNTLYLQMNSLRAEDTAVYYCARDGDVWGQGTTVTVSS

SEQ ID NO: 772 - protein, 121 aa, Homo sapiens
EVQLVESGGGVVQPGRSLRLSCAASGFTFSSYGMHWVRQAPGKGLEWVAVISYDGSNKYYADSVKGRFTISRDNSKNTLYLQVSSLRAEDTAVYYCVRDLVAAAGTAFDIWGQGTTVTVSS

SEQ ID NO: 773 - protein, 120 aa, Homo sapiens
QVQLQQSGPGLVKPSQTLSLTCAVSGDSVSSNFVAWNWIRQSPSRGLEWLGRTYYRSRWYNDYAVSVQSRIRVTPDTSKNQFSLHLDSVTPEDTAVYYCARGQHSGFDFWGQGTLVTVSS

SEQ ID NO: 774 - protein, 126 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDTPGIAARRYYYYGMDVWGQGTTVTVSS

SEQ ID NO: 775 - protein, 121 aa, Homo sapiens
QVQLVQSGGGVVQPGRSLRLSCAASGFTFSSYPMHWVRQAPGKGLEWMTVISSDGRNKYYPDSVKGRFTISRDNSKNTLYLQMNSLRPEDTAVYYCARGGYHDFWSGPDYWGQGTLVTVSS

SEQ ID NO: 776 - protein, 127 aa, Homo sapiens
EVQLVQSGGGLVQPGGSLRLSCAASGFTFSSYAMSWVRQAPGKGLEWVANIKQDGSEKYYVDSVKGRFTISRDNAKNSLYLQMNSLRAEDTAVYYCARDQVSGITIFGGKWRSPDVWGQGTTVTVSS

SEQ ID NO: 777 - protein, 126 aa, Homo sapiens
QVTLKESGGGVVQPGRSLRLSCAASGFTFTNYGLHWVRQAPGKGLEWVAVISHDGTKKYYADSVKGRFTISRDSSENTLYLQMNSLRPEDSALYYCARDGGYCSGGRCYSYGMDVWGQGTTVTVSS

SEQ ID NO: 778 - protein, 122 aa, Homo sapiens
QVQLVQSGGGVVLPGRSLRLSCVASGFTFRRYGMHWVRQAPGKGLEWVSLISYDGSKTFYGESVKGRFTISRDNSKNTLYLQMNSLRAEDTAVYYCARATVTTDGYYYMDVWGKGTTVTVSS

SEQ ID NO: 779 - protein, 89 aa, Homo sapiens
QSVLTQPPSVSPGQTVTISCGSGVSWYQQPGAPKLLIYNRPSGIPDRFSGSKSGNTASLTITGLQAEDAEEYYCSWDVFGGGTKLTVLG

SEQ ID NO: 780 - protein, 111 aa, Homo sapiens
QPVLTQPRSVSGSPGQSVTISCTGTISDVGGHNFVSWYQQNPGKAPKLIIFEVTKRPAGVPDRFSGSKSGNTASLTVSGLQAEDEGEYYCSSYGGSNDVIFGGGTKLSVLG

SEQ ID NO: 781 - protein, 111 aa, Homo sapiens
QSVLTQPPSVSKGLRQTATLTCTGNSNNVGNQGAAWLQQHQGHPPKLLSYRNNNRPSGISERFSASRSGNTASLTITGLQPEDEADYYCSAWDNRLKTYVFGTGGKVTVLG

SEQ ID NO: 782 - protein, 109 aa, Homo sapiens
SSELTQDPAVSVALGQTVRITCQGDSLRKFFASWYQQKPGQAPVLVIYGKNSRPSGIPDRFSGSNSRNTASLTITGAQAEDEGDYYCNSRDSRDNHQVFGAGTKVTVLS

SEQ ID NO: 783 - protein, 108 aa, Homo sapiens
EIVLTQSPATLSVSPGERATLSCRASQSVNTNLAWYQQKPGQAPRLLIYGASSRATGIPDRFSGSGSGTDFTLTISRLEPEDFAVYYCQHYGSSPLTFGGGTKLEIKR

SEQ ID NO: 784 - protein, 107 aa, Homo sapiens
SSELTQDPAVSVALGQTVRITCQGDSLRSYYASWYQQKPGQAPVLVIYGKNNRPSGIPDRFSGSKSHNTAYLTITGAQAEDEADYFCNSRSGSQRVFGGGTKLTVLG

SEQ ID NO: 785 - protein, 111 aa, Homo sapiens
QSVLTQPPSASGTPGQRVTISCSGSRSNIGSNTVNWYQQLPGTAPKLLIYTNNQRPSGVPDRFSGSKSGTSASLAITGLQAEDEADYYCLSFDSSLTSYVFGTGTKVTVLG

SEQ ID NO: 786 - protein, 112 aa, Homo sapiens
QSVLTQPPSASGTPGQRVTISCSGSRSNIGGNTVNWYQQLPGTAPKLLIYANNQRPSGVPDRFSGSKSGTSASLAISGLRSEDEADYYCAAWDDNLSGHVVFGGGTKLTVLR

SEQ ID NO: 787 - protein, 5 aa, Homo sapiens
SYGMH

SEQ ID NO: 788 - protein, 17 aa, Homo sapiens
VISYDGSNKYYADSVKG

SEQ ID NO: 789 - protein, 12 aa, Homo sapiens
DLVAAAGTAFDI

SEQ ID NO: 790 - protein, 14 aa, Homo sapiens
TGTISDVGGHNFVS

SEQ ID NO: 791 - protein, 7 aa, Homo sapiens
EVTKRPA

SEQ ID NO: 792 - protein, 10 aa, Homo sapiens
SSYGGSNDVI

SEQ ID NO: 793 - protein, 7 aa, Homo sapiens
SNFVAWN

SEQ ID NO: 794 - protein, 18 aa, Homo sapiens
RTYYRSRWYNDYAVSVQS

SEQ ID NO: 795 - protein, 8 aa, Homo sapiens
GQHSGFDF

SEQ ID NO: 796 - protein, 13 aa, Homo sapiens
TGNSNNVGNQGAA

SEQ ID NO: 797 - protein, 7 aa, Homo sapiens
RNNNRPS

SEQ ID NO: 798 - protein, 11 aa, Homo sapiens
SAWDNRLKTYV

SEQ ID NO: 799 - protein, 5 aa, Homo sapiens
SYGIS

SEQ ID NO: 800 - protein, 17 aa, Homo sapiens
WISAYNGNTNYAQKLQG

SEQ ID NO: 801 - protein, 17 aa, Homo sapiens
DTPGIAARRYYYYGMDV

SEQ ID NO: 802 - protein, 11 aa, Homo sapiens
QGDSLRKFFAS

SEQ ID NO: 803 - protein, 7 aa, Homo sapiens
GKNSRPS

SEQ ID NO: 804 - protein, 11 aa, Homo sapiens
NSRDSRDNHQV

SEQ ID NO: 805 - protein, 5 aa, Homo sapiens
SYPMH

SEQ ID NO: 806 - protein, 17 aa, Homo sapiens
VISSDGRNKYYPDSVKG

SEQ ID NO: 807 - protein, 12 aa, Homo sapiens
GGYHDFWSGPDY

SEQ ID NO: 808 - protein, 11 aa, Homo sapiens
RASQSVNTNLA

SEQ ID NO: 809 - protein, 7 aa, Homo sapiens
GASSRAT

SEQ ID NO: 810 - protein, 9 aa, Homo sapiens
QHYGSSPLT

SEQ ID NO: 811 - protein, 5 aa, Homo sapiens
SYAMS

SEQ ID NO: 812 - protein, 17 aa, Homo sapiens
NIKQDGSEKYYVDSVKG

SEQ ID NO: 813 - protein, 18 aa, Homo sapiens
DQVSGITIFGGKWRSPDV

SEQ ID NO: 814 - protein, 11 aa, Homo sapiens
QGDSLRSYYAS

SEQ ID NO: 815 - protein, 7 aa, Homo sapiens
GKNNRPS

SEQ ID NO: 816 - protein, 9 aa, Homo sapiens
NSRSGSQRV

SEQ ID NO: 817 - protein, 5 aa, Homo sapiens
NYGLH

SEQ ID NO: 818 - protein, 17 aa, Homo sapiens
VISHDGTKKYYADSVKG

SEQ ID NO: 819 - protein, 17 aa, Homo sapiens
DGGYCSGGRCYSYGMDV

SEQ ID NO: 820 - protein, 13 aa, Homo sapiens
SGSRSNIGSNTVN

SEQ ID NO: 821 - protein, 7 aa, Homo sapiens
TNNQRPS

SEQ ID NO: 822 - protein, 11 aa, Homo sapiens
LSFDSSLTSYV

SEQ ID NO: 823 - protein, 5 aa, Homo sapiens
RYGMH

SEQ ID NO: 824 - protein, 17 aa, Homo sapiens
LISYDGSKTFYGESVKG

SEQ ID NO: 825 - protein, 13 aa, Homo sapiens
ATVTTDGYYYMDV

SEQ ID NO: 826 - protein, 13 aa, Homo sapiens
SGSRSNIGGNTVN

SEQ ID NO: 827 - protein, 7 aa, Homo sapiens
ANNQRPS

SEQ ID NO: 828 - protein, 12 aa, Homo sapiens
AAWDDNLSGHVV

SEQ ID NO: 829 - protein, 3 aa, Homo sapiens
ELR

SEQ ID NO: 830 - protein, 38 aa, Homo sapiens
MEGISIYTSDNYTEEMGSGDYDSMKEPCFREENANFNK

SEQ ID NO: 831 - protein, 38 aa, Macaca mulatta
MEGISIYTSDNYTEEMGSGDYDSIKEPCFREENANFNR

SEQ ID NO: 832 - protein, 38 aa, Mus musculus
MEPISIYTSDNYSEEVGSGDYDSNKEPCFDEENVHFNR

SEQ ID NO: 833 - protein, 14 aa, Homo sapiens
DAVANWYFGNFLCK

SEQ ID NO: 834 - protein, 14 aa, Macaca mulatta
DAVANWYFGNFLCK

SEQ ID NO: 835 - protein, 14 aa, Mus musculus
DAMADWYFKNFLCK

SEQ ID NO: 836 - protein, 27 aa, Homo sapiens
NVSEADDRYICDRFYPNDLWVVVFQFQ

SEQ ID NO: 837 - protein, 27 aa, Macaca mulatta
SVSEADDRYICDRFYPNDLWVVVFQFQ

SEQ ID NO: 838 - protein, 30 aa, Mus musculus
DVSQGDIAQGRYICDRLYPDSLWMVVFQFQ

SEQ ID NO: 839 - protein, 21 aa, Homo sapiens
DSFILLEIIKQGCEFENTVHK

SEQ ID NO: 840 - protein, 21 aa, Macaca mulatta
DSFILLEIIKQGCEFENTVHK

SEQ ID NO: 841 - protein, 21 aa, Mus musculus
DSFILLGVIKQGCDFESIVHK

SEQ ID NO: 842 - protein, 365 aa, Homo sapiens
MEGISIYTSDNYTEEMGSGDYDSMKEPCFREENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSSGTETSQVAPALES

SEQ ID NO: 843 - protein, 341 aa, Homo sapiens
MEPCFREENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSSGTETSQVAPALES

SEQ ID NO: 844 - protein, 334 aa, Homo sapiens
ENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSSGTETSQVAPALES

SEQ ID NO: 845 - protein, 121 aa, Homo sapiens
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCARNGNYRGSLAFDIWGQGTLVTVSS

SEQ ID NO: 846 - protein, 113 aa, Homo sapiens
QSVLTQPPSVSGAPGQRVTISCTGSSSNIGAGYDVHWYQQLPGTAPKLLIYGNNNRPSGVPDRFSGSKSGTSASLAITGLQAEDEADYYCQSYDSSLSAWVVFGGGTKLTVLG

SEQ ID NO: 847 - protein, 119 aa, Homo sapiens
EVQLVQSGGGVVQPGGSLRLSCAASGFPFSSYAMSWVRQAPGKGLEWVSAISANGGTTYYADSVKGRFTISRDNSKNTLYLQMNSLRAEDTAVYYCANNGNYRGAFDIWGQGTMVTVSS

SEQ ID NO: 848 - protein, 119 aa, Homo sapiens
QVQLVQSGGGLVQPGGSLRLSCAASGFPFSSYAMSWVRQAPGKGLEWVSAISANGGTTYYADSVKGRFTISRDNSKNTLYLQMNSLRAEDTAVYYCANNGNYRGAFDIWGQGTMVTVSS

SEQ ID NO: 849 - protein, 119 aa, Homo sapiens; identical to SEQ ID NO: 848

SEQ ID NO: 850 - protein, 119 aa, Homo sapiens
QVQLVQSGGGLVQPGGSLRLSCAASEFTFGTYAMTWVRQAPGKGLEWVSAVSGSGGSTYYADSVKGRFTISRDNSRNTLYLQMNSLRADDTAVYYCARGPVLRYGFDIWGQGTMVTVSS

SEQ ID NO: 851 - protein, 119 aa, Homo sapiens
QVQLVQSGGGVVQPGGSLRLSCAASGFPFSSYAMSWVRQAPGKGLEWVSAISANGGTTYYADSVKGRFTISRDNSKNTLYLQMNSLRAEDTAVYYCANNGNYRGAFDIWGQGTMVTVSS

SEQ ID NO: 852 - protein, 118 aa, Homo sapiens
QVQLQESGGGLVQPGGSLRLSCAASGFTFSIYAMSWVRQAPGKGLEWVSAISGSGGGTYHADSVKGRFTISRDNSKNTLYLQMNSLRAEDTAVYYCAKFSAYSGYDLWGQGTLVTVSS

SEQ ID NO: 853 - protein, 119 aa, Homo sapiens
QVQLVQSGGGLVRPGGSLRLSCAASGFPFSSYAMSWVRQAPGKGLEWVSAISANGGTTYYADSVKGRFTISRDNSKNTLYLQMNSLRAEDTAVYYCANNGNYRGAFDIWGQGTTVTVSS

SEQ ID NO: 854 - protein, 119 aa, Homo sapiens; identical to SEQ ID NO: 848

SEQ ID NO: 855 - protein, 119 aa, Homo sapiens
EVQLVQSGGGLVQPGGSLRLSCAASGFTFSSYAMSWVRQAPGKGLEWVSAISANGGTTYYADSVKGRFTISRDNSKNTLYLQMNSLRAEDTAVYYCANNGNYRGAFDIWGQGTTVTVSS

SEQ ID NO: 856 - protein, 116 aa, Homo sapiens
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCARAAAGFDYWGQGTLVTVSS

SEQ ID NO: 857 - protein, 119 aa, Homo sapiens
QVQLQESGGGLVQPGGSLRLSCAASGFTFSSYAMSWVRQAPGKGLEWVSAISGSGGSTYYADSVKGRFTISRDNSKNTLYLQMNSLRAEDTAVYYCAKIGRYSSSLGYWGQGTLVTVSS

SEQ ID NO: 858 - protein, 122 aa, Homo sapiens
QVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCAREAPYSSSLDAFDIWGQGTMVTVSS

SEQ ID NO: 859 - protein, 118 aa, Homo sapiens
QVQLQESGGGLVQPGGSLRLSCAASGFTFSSYAMSWVRQAPGKGLEWVSAISGSGGSTYYADSVKGRFTISRDNSKNTLYLQMNSLRAEDTAVYYCARSHSSGGFDYWGQGTLVTVSS

SEQ ID NO: 860 - protein, 118 aa, Homo sapiens; identical to SEQ ID NO: 859

SEQ ID NO: 861 - protein, 116 aa, Homo sapiens
QVTLKESGGGVVQPGTSLRLSCAASGFTFSNYAMTWVRQAPGKGLEWVGLISYDGSVTHYTDSVKGRFTISRDNAKNSLYLQMNTLRADDTAVYYCARGSGYQEHWGQGTLVTVSS

SEQ ID NO: 862 - protein, 118 aa, Homo sapiens
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCATYGDYGSLDYWGQGTLVTVSS

SEQ ID NO: 863 - protein, 122 aa, Homo sapiens
QVQLVQSGGGLVQPGGSLRLSCAASGFTFSSYAMSWVRQAPGKGLEWVSAISGSGVSTYYADSVKGRFTISRDNSKNTLYLQMNSLRAEDTAVYYCAKYCSSTSCYRGMDVWGKGTLVTVSS

SEQ ID NO: 864 - protein, 119 aa, Homo sapiens
QVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCARGRAARPPFDYWGQGTLVTVSS

SEQ ID NO: 865 - protein, 119 aa, Homo sapiens; identical to SEQ ID NO: 851

SEQ ID NO: 866 - protein, 121 aa, Homo sapiens
QVQLVQSGGGLVQPGGSLRLSCAAPEFTFSKYAMSWVRQAPGKGLEWVSGISGSGGSTYYADSVKGRFTISRDNSKNTLYLQMNSLRAEDTAVYYCAKSSRSGYFLPLDYWGQGTLVTVSS

SEQ ID NO: 867 - protein, 118 aa, Homo sapiens
EVQLVESGGGVVQPGRSLRLSCAASGFTFSSYGMHWVRQAPGKGLEWVSAISGSGGSTYYADSVKGRFTISRDNAKNTLYLQMNSLRAEDTAVYYCARAAVTGGFDPWGQGTLVTVSS

SEQ ID NO: 868 - protein, 112 aa, Homo sapiens
QSVLTQPPSVSGAPGQRVTISCTGSSSNIGAGFDVHWYQQLPGTAPKLLIYGNTNRPSGVPDRFSGSKSGTSASLAITGLQAEDETDYYCQSYDSRLSAWVFGGGTKLTVLG

SEQ ID NO: 869 - protein, 111 aa, Homo sapiens
QSVLTQPPSVSGAPGQRVTISCTGSSSNIGAGYDVHWYQQLPGTAPKLLIYGNSNRPSGVPDRFSGSKSGSSASLAITGLQAEDEAHYYCQSYDRSLSWVFGGGTKLTVLG

SEQ ID NO: 870 - protein, 112 aa, Homo sapiens
QSVLTQPPSVSGAPGQRVTISCTGSSSNIGAGYDVHWYQQLPGTAPKLLIYGNTNRPSGVPDRFSGSKSGTSASLAIIGLQADDEADYYCQSYDSTLRVWMFGGGTKLTVLG

SEQ ID NO: 871 - protein, 112 aa, Homo sapiens
QSVLTQPPSVSGAPGQRITISCTGSRSNIGADYDVHWYQQLPGTAPKLLIYANNNRPSGVPGRFSASKSGTSASLAISGLQAEDEADYYCQSYDSSLRAWVFGGGTKLAVLG

SEQ ID NO: 872 - protein, 112 aa, Homo sapiens
QSVLTQPPSVSGAPGQRITISCTGSRSNIGADYDVHWYQQLPGTAPKLLIYANNNRPSGVPDRFSGSKSGTSASLAITGLQAEDETDYFCQSYDSSLSAWVFGGGTKVTVLG

SEQ ID NO: 873 - protein, 111 aa, Homo sapiens
QSVLTQPPSVSGAPGQRVTISCTGSSSNIGRGYNVHWYQQLPGTAPKLLIYDNTNRPSGVPARFSGSKSATSASLTITGLQADDEADYYCQSYDSGLRWVFGGGTKLTLLG

SEQ ID NO: 874 - protein, 111 aa, Homo sapiens
QSVLTQPPSVSGAPGQRITISCTGSSSNIGAGYDVHWYQQVPGKAPKVVIYGNNNRPSGVPDRFSGSKSGASASLAITGLQTEDEADYYCQSYDKSLTWVFGGGTKVTVLG

SEQ ID NO: 875 - protein, 111 aa, Homo sapiens
QSVLTQPPSVSGAPGQRITISCTGTSSNIGAGYDVHWYQQLPGAAPRVLIYGNNNRPSGVPDRFSGSKSGTSASLAITGLQSEDEADYYCQSYDKSLSWVFGGGTKLTVLR

SEQ ID NO: 876 - protein, 112 aa, Homo sapiens
QSVLTQPPSVSGAPGQRVTISCTGSSSNIGAGFDVHWYQQLPGTAPRLLIYGNNNRPSGVPDRFSGSKSGTSASLAITGLQAEDETDYFCQSYDSSLSAWVFGGGTKVTVLR

SEQ ID NO: 877 - protein, 112 aa, Homo sapiens
QSVLTQPPSVSGAPGQRVTISCTGSSSNIGRGYNVHWYQQLPGTAPKLLIYDDTNRPSGVPHRFSGSKSGTSASLAITGLQAEDEADYYCQSYDSSLRAWVFGGGTKLAVLG

SEQ ID NO: 878 - protein, 111 aa, Homo sapiens
QSVLTQPPSVSGAPGQRVTISCTGSSSNIGRGYNVHWYQQLPGTAPKLLIYDNTNRPSGVPARFSGSKSATSASLAITGLQADDEADYYCQSYDSGLRWVFGGGTKLTLLR

SEQ ID NO: 879 - protein, 111 aa, Homo sapiens
QSVLTQPPSVSGAPGQRVTISCTGSSSNIGRGYNVHWYQQLPGTAPKLLIYGNSNRPSGVPDRFSGSSSGNTASLTITGAQAEDEADYYCHSRDNNGHHIFGGGTKLTVLS

SEQ ID NO: 880 - protein, 112 aa, Homo sapiens
QSVLTQPPSVSGAPGQRVTISCTGSSSNIGRGYNVHWYQQLPGTAPKLLIYGNTNRPSGVPDRFSGSKSGTSASLAITGLQAEDEGDYYCQSYDSSLSAWVFGGGTKLTVLG

SEQ ID NO: 881 - protein, 112 aa, Homo sapiens
  MOD_RES (83)..(83): Any naturally occurring amino acid
QSVLTQPPSVSGAPGQRVTISCTGSSSNIGRGYNVHWYQQLPGTAPKLLIYGNTNRPSGVPDRFSGSKSGTSASLAITGLQAXDEGDYYCQSYDSSLSAWVFGGGTKLTVLG

SEQ ID NO: 882 - protein, 110 aa, Homo sapiens
LPVLTQPPSVSVAPGQTARITCGGNNIGSKSVHWYQQKPGQAPVLVIYYDSDRPSGIPERFSGSNSGNTATLTISRVEAGDEADYYCQVWDSSSDHHVVFGGGTKLTVLG

SEQ ID NO: 883 - protein, 112 aa, Homo sapiens
QSVLTQPPSVSGAPGQRVTISCTGSSSNIGAGYDVHWYQQLPGTAPKLLIYANNNRPSGVPDRFSGSKSGTSASLAITGLQAEDEADYYCQSYDSSLRAWVFGGGTKLAVLG

SEQ ID NO: 884 - protein, 112 aa, Homo sapiens; identical to SEQ ID NO: 883

SEQ ID NO: 885 - protein, 111 aa, Homo sapiens
QPVLTQPPSASGTPGQRVTISCSGSSSNIGSNYVYWYQQLPGTAPKLPIYRNNQRPSGVPDRFSGSKSGTSASLAISGLRSEDEADYYCAAWDDSLNGVVFGGGTKLTVLR

SEQ ID NO: 886 - protein, 112 aa, Homo sapiens
QSVLTQPPSVSGAPGQRVTISCTGSSSNIGAGYDVHWYQHLPGTAPKLLIYGNSNRPSGVPDRFSGSKSGTSASLAITGLQAEDETDYFCQSYDSSLSAWVFGGGTKVTVLG

SEQ ID NO: 887 - protein, 109 aa, Homo sapiens
SSELTQDPAVSVALGQTVRITCQGNSLRYYYPSWYQQKPGQAPVLVIYGKNNRPSGIPDRFSGSSSGNTASLTITGTQAEDEADYYCSSRDNTDNRVVFGGGTKLTVLG

SEQ ID NO: 888 - protein, 109 aa, Homo sapiens
QPGLTQPPSVSVAPGQTARITCGGDNIGRKSVHWYQQRPGQAPILVIRDDRDRPSGIPERFSGSSSVNTATLIISRVEAGDEADYYCQVWDSSSKHYVFGPGTKVTALG

SEQ ID NO: 889 - protein, 458 aa, Homo sapiens
MAPLCPSPWLPLLIPAPAPGLTVQLLLSLLLLMPVHPQRLPRMQEDSPLGGGSSGEDDPLGEEDLPSEEDSPREEDPPGEEDLPGEEDLPGEEDLPEVKPKSEEEGSLKLEDLPTVEAPGDPQEPQNNAHRDKEGDDQSHWRYGGDPPWPRVSPACAGRFQSPVDIRPQLAAFCPALRPLELLGFQLPPLPELRLRNNGHSVQLTLPPGLEMALGPGREYALQLHLHWGAAGRPGSEHTVEGHRFPAEIHVVHLSTAFARVDEALGRPGGLAVLAAFLEEGPEENSAYEQLLSRLEEIAEEGSETQVPGLDISALLPSDFSRYFQYEGSLTTPPCAQGVIWTVFNQTVMLSAKQLHTLSDTLWGPGDSRLQLNFRATQPLNGRVIEASFPAGVDSSPRAAEPVQLNSCLAAGDILALVFGLLFAVTSVAFLVQMRRQHRRGTKGGVSYRPAEVAETGA

SEQ ID NO: 890 - protein, 437 aa, Mus musculus
MASLGPSPWAPLSTPAPTAQLLLFLLLQVSAQPQGLSGMQGEPSLGDSSSGEDELGVDVLPSEEDAPEEADPPDGEDPPEVNSEDRMEESLGLEDLSTPEAPEHSQGSHGDEKGGGHSHWSYGGTLLWPQVSPACAGRFQSPVDIRLERTAFCRTLQPLELLGYELQPLPELSLSNNGHTVQLTLPPGLKMALGPGQEYRALQLHLHWGTSDHPGSEHTVNGHRFPAEIHVVHLSTAFSELHEALGRPGGLAVLAAFLQESPEENSAYEQLLSHLEEISEEGSKIEIPGLDVSALLPSDFSRYYRYEGSLTTPPCSQGVIWTVFNETVKLSAKQLHTLSVSLWGPRDSRLQLNFRATQPLNGRTIEASFPAAEDSSPEPVHVNSCFTAGDILALVFGLLFAVTSIAFLLQLRRQHRHRSGTKDRVSYSPAEMTETGA

SEQ ID NO: 891 - DNA, 38 bp, Artificial Sequence
  Description of Artificial Sequence: Synthetic Chemically synthesized primer
atcgacgcgtgcctgagcgaggtgcagctggtgcagtc

SEQ ID NO: 892 - DNA, 32 bp, Artificial Sequence
  Description of Artificial Sequence: Synthetic Chemically synthesized primer
caatggtcaccgtctcttcagctagcaccagg

SEQ ID NO: 893 - DNA, 35 bp, Artificial Sequence
  Description of Artificial Sequence: Synthetic Chemically synthesized primer
atcccaagcttaagccagtctgtgctgactcagcc

SEQ ID NO: 894 - DNA, 31 bp, Artificial Sequence
  Description of Artificial Sequence: Synthetic Chemically synthesized primer
ggagggaccaaattgaccgtcctaggtcagc

SEQ ID NO: 895 - DNA, 41 bp, Artificial Sequence
  Description of Artificial Sequence: Synthetic Chemically synthesized primer
tagggcacgcgtgtgctgagcgaggtgcagctggtgcagtc

SEQ ID NO: 896 - DNA, 32 bp, Artificial Sequence
  Description of Artificial Sequence: Synthetic Chemically synthesized primer
tctagtgctagctgaagagacggtgaccattg

SEQ ID NO: 897 - DNA, 35 bp, Artificial Sequence
  Description of Artificial Sequence: Synthetic Chemically synthesized primer
ctagcaagcttatcccagtctgtgctgactcagcc

SEQ ID NO: 898 - DNA, 26 bp, Artificial Sequence
  Description of Artificial Sequence: Synthetic Chemically synthesized primer
atagcacctaggacggtcagcttggt

SEQ ID NO: 899 - protein, 5 aa, Artificial Sequence
  Description of Artificial Sequence: Synthetic Portion of CDR1 heavy chain sequence
SYAMS

SEQ ID NO: 900 - protein, 5 aa, Artificial Sequence
  Description of Artificial Sequence: Synthetic Portion of CDR1 heavy chain sequence
  MOD_RES (1)..(1): Any naturally occurring amino acid
  MOD_RES (5)..(5): Any naturally occurring amino acid
XYAMX

SEQ ID NO: 901 - protein, 5 aa, Artificial Sequence
  Description of Artificial Sequence: Synthetic Portion of CDR1 heavy chain sequence
  MOD_RES (3)..(3): Any naturally occurring amino acid
  MOD_RES (5)..(5): Any naturally occurring amino acid
SYXMX

SEQ ID NO: 902 - protein, 17 aa, Artificial Sequence
  Description of Artificial Sequence: Synthetic Portion of CDR2 heavy chain sequence
  MOD_RES (4)..(5): Any naturally occurring amino acid
  MOD_RES (8)..(8): Any naturally occurring amino acid
  MOD_RES (10)..(11): Any naturally occurring amino acid
AISXXGGXTXXADSVKG

SEQ ID NO: 903 - protein, 17 aa, Artificial Sequence
  Description of Artificial Sequence: Synthetic Portion of CDR2 heavy chain sequence
AISGSGGSTTTADSVKG

SEQ ID NO: 904 - protein, 13 aa, Artificial Sequence
  Description of Artificial Sequence: Synthetic Portion of CDR3 heavy chain sequence
  MOD_RES (9)..(9): Any naturally occurring amino acid
NGNYRGSLXAFDI

SEQ ID NO: 905 - protein, 14 aa, Artificial Sequence
  Description of Artificial Sequence: Synthetic Portion of CDR1 light chain sequence
TGSSSNIGAGYDVH

SEQ ID NO: 906 - protein, 7 aa, Artificial Sequence
  Description of Artificial Sequence: Synthetic Portion of CDR2 light chain sequence
GNNNRPS

SEQ ID NO: 907 - protein, 12 aa, Artificial Sequence
  Description of Artificial Sequence: Synthetic Portion of CDR3 light chain sequence
QSYDSSLSAWVV

SEQ ID NO: 908 - protein, 6 aa, Artificial Sequence
  Description of Artificial Sequence: Synthetic Consensus sequence
EEDLPE

SEQ ID NO: 909 - protein, 10 aa, Artificial Sequence
  Description of Artificial Sequence: Synthetic Portion of the CDR3 heavy chain sequence
NGNYRGAFDI

SEQ ID NO: 910 - protein, 5 aa, Artificial Sequence
  Description of Artificial Sequence: Synthetic Variable heavy chain, CDR1
TYAMT

SEQ ID NO: 911 - protein, 5 aa, Artificial Sequence
  Description of Artificial Sequence: Synthetic Variable heavy chain, CDR1
IYAMS

SEQ ID NO: 912 - protein, 5 aa, Artificial Sequence
  Description of Artificial Sequence: Synthetic Variable heavy chain, CDR1
SYGMH

SEQ ID NO: 913 - protein, 5 aa, Artificial Sequence
  Description of Artificial Sequence: Synthetic Variable heavy chain, CDR1
NYAMT

SEQ ID NO: 914 - protein, 5 aa, Artificial Sequence
  Description of Artificial Sequence: Synthetic Variable heavy chain, CDR1
KYAMS

SEQ ID NO: 915 - protein, 17 aa, Artificial Sequence
  Description of Artificial Sequence: Synthetic Variable heavy chain, CDR2
AISANGGTTYYADSVKG

SEQ ID NO: 916 - protein, 17 aa, Artificial Sequence
  Description of Artificial Sequence: Synthetic Variable heavy chain, CDR2
AVSGSGGSTYYADSVKG

SEQ ID NO: 917 - protein, 17 aa, Artificial Sequence
  Description of Artificial Sequence: Synthetic Variable heavy chain, CDR2
AISGSGGGTYHADSVKG

SEQ ID NO: 918 - protein, 17 aa, Artificial Sequence
  Description of Artificial Sequence: Synthetic Variable heavy chain, CDR2
AISGSGGSTYYADSVKG

SEQ ID NO: 919 - protein, 17 aa, Artificial Sequence
  Description of Artificial Sequence: Synthetic Variable heavy chain, CDR2
VISYDGSNKYYADSVKG

SEQ ID NO: 920 - protein, 17 aa, Artificial Sequence
  Description of Artificial Sequence: Synthetic Variable heavy chain, CDR2
LISYDGSVTHYTDSVKG

SEQ ID NO: 921 - protein, 17 aa, Artificial Sequence
  Description of Artificial Sequence: Synthetic Variable heavy chain, CDR2
AISGSGVSTYYADSVKG

SEQ ID NO: 922 - protein, 17 aa, Artificial Sequence
  Description of Artificial Sequence: Synthetic Variable heavy chain, CDR2
GISGSGGSTYYADSVKG

SEQ ID NO: 923 - protein, 10 aa, Artificial Sequence
  Description of Artificial Sequence: Synthetic Variable heavy chain, CDR3
GPVLRYGFDI

SEQ ID NO: 924 - protein, 9 aa, Artificial Sequence
  Description of Artificial Sequence: Synthetic Variable heavy chain, CDR3
FSAYSGYDL

SEQ ID NO: 925 - protein, 7 aa, Artificial Sequence
  Description of Artificial Sequence: Synthetic Variable heavy chain, CDR3
AAAGFDY

SEQ ID NO: 926 - protein, 10 aa, Artificial Sequence
  Description of Artificial Sequence: Synthetic Variable heavy chain, CDR3
IGRYSSSLGY

SEQ ID NO: 927 - protein, 13 aa, Artificial Sequence
  Description of Artificial Sequence: Synthetic Variable heavy chain, CDR3
EAPYSSSLDAFDI

SEQ ID NO: 928 - protein, 9 aa, Artificial Sequence
  Description of Artificial Sequence: Synthetic Variable heavy chain, CDR3
SHSSGGFDY

SEQ ID NO: 929 - protein, 7 aa, Artificial Sequence
  Description of Artificial Sequence: Synthetic Variable heavy chain, CDR3
GSGYQEH

SEQ ID NO: 930 - protein, 9 aa, Artificial Sequence
  Description of Artificial Sequence: Synthetic Variable heavy chain, CDR3
YGDYGSLDY

SEQ ID NO: 931 - protein, 13 aa, Artificial Sequence
  Description of Artificial Sequence: Synthetic Variable heavy chain, CDR3
YCSSTSCYRGMDV

SEQ ID NO: 932 - protein, 10 aa, Artificial Sequence
  Description of Artificial Sequence: Synthetic Variable heavy chain, CDR3
GRAARPPFDY

SEQ ID NO: 933 - protein, 12 aa, Artificial Sequence
  Description of Artificial Sequence: Synthetic Variable heavy chain, CDR3
SSRSGYFLPLDY

SEQ ID NO: 934 - protein, 9 aa, Artificial Sequence
  Description of Artificial Sequence: Synthetic Variable heavy chain, CDR3
AAVTGGFDP

SEQ ID NO: 935 - protein, 14 aa, Artificial Sequence
  Description of Artificial Sequence: Synthetic Variable light chain, CDR3
TGSSSNIGAGYDVH

SEQ ID NO: 936 - protein, 14 aa, Artificial Sequence
  Description of Artificial Sequence: Synthetic Variable light chain, CDR1
TGSRSNIGADYDVH

SEQ ID NO: 937 - protein, 14 aa, Artificial Sequence
  Description of Artificial Sequence: Synthetic Variable light chain, CDR1
TGSSSNIGRGYNVH

SEQ ID NO: 938 - protein, 14 aa, Artificial Sequence
  Description of Artificial Sequence: Synthetic Variable light chain, CDR1
TGTSSNIGAGYDVH

SEQ ID NO: 939 - protein, 11 aa, Artificial Sequence
  Description of Artificial Sequence: Synthetic Variable light chain, CDR1
GGNNIGSKSVH

SEQ ID NO: 940 - protein, 13 aa, Artificial Sequence
  Description of Artificial Sequence: Synthetic Variable light chain, CDR1
SGSSSNIGSNYVY

SEQ ID NO: 941 - protein, 11 aa, Artificial Sequence
  Description of Artificial Sequence: Synthetic Variable light chain, CDR1
QGNSLRYYYPS

SEQ ID NO: 942 - protein, 11 aa, Artificial Sequence
  Description of Artificial Sequence: Synthetic Variable light chain, CDR1
GGDNIGRKSVH

SEQ ID NO: 943 - protein, 7 aa, Artificial Sequence
  Description of Artificial Sequence: Synthetic Variable light chain, CDR2
GNSNRPS

SEQ ID NO: 944 - protein, 7 aa, Artificial Sequence
  Description of Artificial Sequence: Synthetic Variable light chain, CDR2
ANNNRPS

SEQ ID NO: 945 - protein, 7 aa, Artificial Sequence
  Description of Artificial Sequence: Synthetic Variable light chain, CDR2
DNTNRPS

SEQ ID NO: 946 - protein, 7 aa, Artificial Sequence
  Description of Artificial Sequence: Synthetic Variable light chain, CDR2
GNNNRPS

SEQ ID NO: 947 - protein, 7 aa, Artificial Sequence
  Description of Artificial Sequence: Synthetic Variable light chain, CDR2
DDTNRPS

SEQ ID NO: 948 - protein, 7 aa, Artificial Sequence
  Description of Artificial Sequence: Synthetic Variable light chain, CDR2
YDSDRPS

SEQ ID NO: 949 - protein, 7 aa, Artificial Sequence
  Description of Artificial Sequence: Synthetic Variable light chain, CDR2
RNNQRPS

SEQ ID NO: 950 - protein, 7 aa, Artificial Sequence
  Description of Artificial Sequence: Synthetic Variable light chain, CDR2
GKNNRPS

SEQ ID NO: 951 - protein, 7 aa, Artificial Sequence
  Description of Artificial Sequence: Synthetic Variable light chain, CDR2
DDRDRPS

SEQ ID NO: 952 - protein, 11 aa, Artificial Sequence
  Description of Artificial Sequence: Synthetic Variable light chain, CDR3
QSYDSRLSAWV

SEQ ID NO: 953 - protein, 10 aa, Artificial Sequence
  Description of Artificial Sequence: Synthetic Variable light chain, CDR3
QSYDRSLSWV

SEQ ID NO: 954 - protein, 11 aa, Artificial Sequence
  Description of Artificial Sequence: Synthetic Variable light chain, CDR3
QSYDSTLRVWM

SEQ ID NO: 955 - protein, 11 aa, Artificial Sequence
  Description of Artificial Sequence: Synthetic Variable light chain, CDR3
QSYDSSLRAWV

SEQ ID NO: 956 - protein, 11 aa, Artificial Sequence
  Description of Artificial Sequence: Synthetic Variable light chain, CDR3
QSYDSSLSAWV

SEQ ID NO: 957 - protein, 10 aa, Artificial Sequence
  Description of Artificial Sequence: Synthetic Variable light chain, CDR3
QSYDSGLRWV

SEQ ID NO: 958 - protein, 10 aa, Artificial Sequence
  Description of Artificial Sequence: Synthetic Variable light chain, CDR3
QSYDKSLTWV

SEQ ID NO: 959 - protein, 10 aa, Artificial Sequence
  Description of Artificial Sequence: Synthetic Variable light chain, CDR3
QSYDKSLSWV

SEQ ID NO: 960 - protein, 11 aa, Artificial Sequence
  Description of Artificial Sequence: Synthetic Variable light chain, CDR3
QSYDSSLSAWV

SEQ ID NO: 961 - protein, 10 aa, Artificial Sequence
  Description of Artificial Sequence: Synthetic Variable light chain, CDR3
HSRDNNGHHI

SEQ ID NO: 962 - protein, 12 aa, Artificial Sequence
  Description of Artificial Sequence: Synthetic Variable light chain, CDR3
QVWDSSSDHHVV

SEQ ID NO: 963 - protein, 11 aa, Artificial Sequence
  Description of Artificial Sequence: Synthetic Variable light chain, CDR3
AAWDDSLNGVV

SEQ ID NO: 964 - protein, 11 aa, Artificial Sequence
  Description of Artificial Sequence: Synthetic Variable light chain, CDR3
SSRDNTDNRVV

SEQ ID NO: 965 - protein, 11 aa, Artificial Sequence
  Description of Artificial Sequence: Synthetic Variable light chain, CDR3
QVWDSSSKHYV

SEQ ID NO: 966 - DNA, 354 bp, Homo sapiens
caggtgcagctggtgcagagcggagccgaggtgaagaagcctggagcttccgtcaaggtgtcctgcaaggccagcggctacaccttcgccagctactacatgcactggatgcggcaggcacctggacagggcctcgaatggatcggctggatcaaccccggcaacgtgaacaccaagtacaacgagaagttcaagggcagggccaccctgaccgtggacaccagcaccaacaccgcctacatggaactgagcagcctgcggagcgaggacaccgccgtgtactactgcgccagaagcacctactaccggcccctggactactggggccagggcaccctggtgaccgtgagcagc

SEQ ID NO: 967 - protein, 118 aa, Homo sapiens
QVQLVQSGAEVKKPGASVKVSCKASGYTFASYYMHWMRQAPGQGLEWIGWINPGNVNTKYNEKFKGRATLTVDTSTNTAYMELSSLRSEDTAVYYCARSTYYRPLDYWGQGTLVTVSS

SEQ ID NO: 968 - DNA, 336 bp, Homo sapiens
gacatcgtgatgacccagagccccgacagcctggccgtgagcctgggcgagcgggccaccatcaactgcaagagcagccagagcatcctgtacagcagcaaccagaagaactacctggcctggtatcagcagaagcccggccagagccccaagctgctgatctactgggccagcacccgggagagcggcgtgcccgaccggtttagcggcagcggctccggcaccgacttcaccctgaccatcagcagcctgcaggccgaggacgtggccgtgtactactgccaccagtacctgagcagctacaccttcggccagggcacaaagctggaaatcaag

SEQ ID NO: 969 - protein, 112 aa, Homo sapiens
DIVMTQSPDSLAVSLGERATINCKSSQSILYSSNQKNYLAWYQQKPGQSPKLLIYWASTRESGVPDRFSGSGSGTDFTLTISSLQAEDVAVYYCHQYLSSYTFGQGTKLEIK

SEQ ID NO: 970 - protein, 8 aa, Homo sapiens
GYTFASYY

SEQ ID NO: 971 - protein, 17 aa, Homo sapiens
WINPGNVNTKYNEKFKG

SEQ ID NO: 972 - protein, 9 aa, Homo sapiens
STYYRPLDY

SEQ ID NO: 973 - protein, 17 aa, Homo sapiens
KSSQSILYSSNQKNYLA

SEQ ID NO: 974 - protein, 7 aa, Homo sapiens
WASTRES

SEQ ID NO: 975 - protein, 8 aa, Homo sapiens
HQYLSSYT

SEQ ID NO: 976 - protein, 17 aa, Homo sapiens
  MOD_RES (4)..(5): Any naturally occurring amino acid
  MOD_RES (7)..(7): Any naturally occurring amino acid
  MOD_RES (9)..(9): Any naturally occurring amino acid
WINXXNXNXKYNEKFKG

SEQ ID NO: 977 - protein, 9 aa, Homo sapiens
  MOD_RES (2)..(2): Any naturally occurring amino acid
  MOD_RES (4)..(5): Any naturally occurring amino acid
  MOD_RES (9)..(9): Any naturally occurring amino acid
SXYXXPLDX

SEQ ID NO: 978 - protein, 17 aa, Homo sapiens
  MOD_RES (6)..(6): Any naturally occurring amino acid
  MOD_RES (10)..(13): Any naturally occurring amino acid
KSSQSXLYSXXXXNYLA

SEQ ID NO: 979 - protein, 7 aa, Homo sapiens
  MOD_RES (4)..(5): Any naturally occurring amino acid
WASXXES

SEQ ID NO: 980 - protein, 8 aa, Homo sapiens
  MOD_RES (5)..(6): Any naturally occurring amino acid
HQYLXXYT

SEQ ID NO: 981 - DNA, 369 bp, Homo sapiens
caggtgcagctggtgcagtctggggctgaggtgaagaagcctgggtcctcggtgaaggtctcctgcaaggcttctggaggcaccttcagtgacaatgctatcagctgggtgcgacaggccccaggacaagggcttgagtggatggggggcatcattcctatctttggaaaaccaaactacgcacagaagttccagggcagagtcacgattactgcggacgaatccacgagcacagcctacatggacctgaggagcctgagatctgaggacacggccgtttattactgtgcgagagattcagacgcgtattactatggttcggggggtatggacgtctggggccaaggcaccctggtcaccgtctcctca

SEQ ID NO: 982 - protein, 123 aa, Homo sapiens
QVQLVQSGAEVKKPGSSVKVSCKASGGTFSDNAISWVRQAPGQGLEWMGGIIPIFGKPNYAQKFQGRVTITADESTSTAYMDLRSLRSEDTAVYYCARDSDAYYYGSGGMDVWGQGTLVTVSS

SEQ ID NO: 983 - DNA, 335 bp, Homo sapiens
ctgcctgtgctgactcaatcatcctctgcctctgcttccctgggatcctcggtcaagctcacctgcactctgagcagtgggcatagtaactacatcatcgcatggcatcaacagcagccagggaaggcccctcggtacttgatgaaggttaatagtgatggcagccacaccaagggggacgggatccctgatcgcttctcaggctccagctctggggctgaccgctacctcaccatctccaacctccagtctgaggatgaggctagttatttctgtgagacctgggacactaagattcatgtcttcggaactgggaccaaggtctccgtcctcag

SEQ ID NO: 984 - protein, 111 aa, Homo sapiens
LPVLTQSSSASASLGSSVKLTCTLSSGHSNYIIAWHQQQPGKAPRYLMKVNSDGSHTKGDGIPDRFSGSSSGADRYLTISNLQSEDEASYFCETWDTKIHVFGTGTKVSVL

SEQ ID NO: 985 - DNA, 363 bp, Homo sapiens
caggtgcagctggtgcagtctggggctgaggtgaagaagcctgggtcctcggtgaaggtctcctgcaaggctcctggaggtatcttcaacaccaatgctttcagctgggtccgacaggcccctggacaaggtcttgagtgggtgggaggggtcatccctttgtttcgaacagcaagctacgcacagaacgtccagggcagagtcaccattaccgcggacgaatccacgaacacagcctacatggagcttaccagcctgagatctgcggacacggccgtgtattactgtgcgagaagtagtggttaccattttaggagtcactttgactcctggggcctgggaaccctggtcaccgtctcctca

SEQ ID NO: 986 - protein, 121 aa, Homo sapiens
QVQLVQSGAEVKKPGSSVKVSCKAPGGIFNTNAFSWVRQAPGQGLEWVGGVIPLFRTASYAQNVQGRVTITADESTNTAYMELTSLRSADTAVYYCARSSGYHFRSHFDSWGLGTLVTVSS

SEQ ID NO: 987 - DNA, 363 bp, Homo sapiens
caggtgcagctggtgcaatctggggctgaggtgaagaagcctgggtcctcggtgaaggtctcctgcaaggctcctggaggtatcttcaacaccaatgctttcagctgggtccgacaggcccctggacaaggtcttgagtgggtgggaggggtcatccctttgtttcgaacagcaagctacgcacagaacgtccagggcagagtcaccattaccgcggacgaatccacgaacacagcctacatggagcttaccagcctgagatctgcggacacggccgtgtattactgtgcgagaagtagtggttaccattttaggagtcactttgactcctggggcctgggaaccctggtcaccgtctcctca

SEQ ID NO: 988 - protein, 111 aa, Homo sapiens
NFMLTQPHSVSASPGKTVTISCTGSSGNIAANYVQWYQQRPGSAPTTVIYEDDRRPSGVPDRFSGSIDRSSNSASLTISGLKTEDEADYYCQTYDTNNHAVFGGGTHLTVL

SEQ ID NO: 989 - DNA, 333 bp, Homo sapiens
aattttatgctgactcagccccactctgtgtcggcgtctccggggaagacggtgaccatctcctgcaccggcagcagtggcaacattgccgccaactatgtgcagtggtaccaacaacgtccgggcagtgcccccactactgtgatctatgaggatgaccgaagaccctctggggtccctgatcggttctctggctccatcgacaggtcctccaactctgcctccctcaccatctcaggactgaagactgaggacgaggctgactactactgtcagacttatgataccaacaatcatgctgtgttcggaggaggcacccacctgaccgtcctc

SEQ ID NO: 990 - protein, 110 aa, Homo sapiens
SYELTQPPSASGKHGQRVTISCSGGTSNIGRNHVNWYQQLPGTAPKLLIYSNEQRPSGVPDRFSGSKSGTSASLAVSGLQSEDEADYYCASWDDNLSGWVFGGGTKLTVL

SEQ ID NO: 991 - DNA, 330 bp, Homo sapiens
tcctatgagctgactcagccaccctcagcgtctgggaaacacgggcagagggtcaccatctcttgttctggaggcacctccaacatcggacgtaatcatgttaactggtaccagcaactcccaggaacggcccccaaactcctcatctatagtaatgaacagcggccctcaggggtccctgaccgattctctggctccaaatctggcacctccgcctccctggccgtgagtgggctccagtctgaggatgaggctgattattactgtgcatcatgggatgacaacttgagtggttgggtgttcggcggagggaccaagctgaccgtccta

SEQ ID NO: 992 - protein, 120 aa, Homo sapiens
QVQLVQSGAEVKKPGSSVKVSCKASGGTFSAYAFTWVRQAPGQGLEWMGGITGMFGTANYAQKFQGRVTITADELTSTAYMELSSLTSEDTALYYCARGLYYYESSLDYWGQGTLVTVSS

SEQ ID NO: 993 - DNA, 361 bp, Homo sapiens
caggtgcagctggtgcagtctggggctgaggtgaagaagcctgggtcctcggtgaaggtctcctgcaaggcttctggaggcaccttcagcgcttatgctttcacctgggtgcggcaggcccctggacaagggcttgagtggatgggaggcatcaccggaatgtttggcacagcaaactacgcacagaagttccagggcagagtcacgattaccgcggacgaactcacgagcacagcctacatggagttgagctccctgacatctgaagacacggccctttattattgtgcgagaggattgtattactatgagagtagtcttgactattggggccagggaaccctggtcaccgtctcctcag

SEQ ID NO: 994 - protein, 110 aa, Homo sapiens
QSVLTQPPSASGSPGQSVTISCTGTSSDVGGYNSVSWYQQHPGKAPKLMIYEVTKRPSGVPDRFSASKSGNTASLTVSGLQAEDEADYFCCSYAGHSAYVFGTGTKVTVL

SEQ ID NO: 995 - DNA, 361 bp, Homo sapiens
caggtgcagctggtgcagtctggggctgaggtgaagaagcctgggtcctcggtgaaggtctcctgcagggcttctggaggcaccttcagcgcttatgctttcacctgggtgcggcaggcccctggacaagggcttgagtggatgggaggcatcaccggaatgtttggcacagcaaactacgcacagaagttccagggcagagtcacgattaccgcggacgaactcacgagcacagcctacatggagttgagctccctgacatctgaagacacggccctttattattgtgcgagaggattgtattactatgagagtagtcttgactattggggccagggaaccctggtcaccgtctcctcag

SEQ ID NO: 996 - protein, 108 aa, Homo sapiens
EIVLTQSPGTLSLSPGERATLSCRASQSLSSKYLAWYQQKPGQAPRLLIYGASSRATGIPDRFSGSGSGTDFTLTISRLEPEDFAVYSCQQYDGVPRTFGQGTTVEIK

SEQ ID NO: 997 - DNA, 330 bp, Homo sapiens
cagtctgtgctgactcagccaccctccgcgtccgggtctcctggacagtcagtcaccatctcctgcactggaaccagcagtgacgttggtggttataactctgtctcctggtaccaacagcacccaggcaaagcccccaaactcatgatttatgaggtcactaagcggccctcaggggtccctgatcgcttctctgcctccaagtctggcaacacggcctccctgaccgtctctgggctccaggctgaggatgaggctgattatttctgctgctcatatgcaggccacagtgcttatgtcttcggaactgggaccaaggtcaccgtcctg

SEQ ID NO: 998 - protein, 124 aa, Homo sapiens
QVQLVQSGAEVKKPGSSVKVSCTSSEVTFSSFAISWVRQAPGQGLEWLGGISPMFGTPNYAQKFQGRVTITADQSTRTAYMDLRSLRSEDTAVYYCARSPSYICSGGTCVFDHWGQGTLVTVSS

SEQ ID NO: 999 - DNA, 324 bp, Homo sapiens
gaaattgtgctgactcagtctccaggcaccctgtctttgtctccaggggaaagagccaccctctcctgcagggccagtcagagtcttagcagcaagtacttagcctggtatcagcagaaacctggccaggctcccaggctcctcatctatggtgcatccagcagggccactggcatcccagacaggttcagtggcagtgggtctgggacagacttcaccctcaccatcagtagactggagcctgaagattttgcagtgtattcctgtcagcagtatgatggcgtacctcggacgttcggccaagggaccacggtggaaatcaaa

SEQ ID NO: 1000 - protein, 110 aa, Homo sapiens
QPGLTQPPSVSKGLRQTATLTCTGNSNNVGNQGAAWLQQHQGHPPKLLSYRNNDRPSGISERFSASRSGNTASLTITGLQPEDEADYYCSTWDSSLSAVVFGGGTKLTVL

SEQ ID NO: 1001 - DNA, 372 bp, Homo sapiens
caggtgcagctggtgcagtcaggggctgaggtgaagaagcctgggtcctcggtgaaggtctcctgcacgtcctctgaagtcaccttcagtagttttgctatcagctgggtgcgacaggcccctggacaagggcttgagtggctgggagggatcagccctatgtttggaacacctaattacgcgcagaagttccaaggcagagtcaccattaccgcggaccagtccacgaggacagcctacatggacctgaggagcctgagatctgaggacacggccgtgtattattgtgcgagatctccttcttacatttgttctggtggaacctgcgtctttgaccattggggccagggaaccctggtcaccgtctcctca

SEQ ID NO: 1002 - protein, 107 aa, Homo sapiens
DIQMTQSPSSLSASVGDRVTITCRASQSISSYLNWYQQKPGKAPKLLIYAASSLQRGVPSRFSGSGSGTDFTLTISSLQPEDFAVYYCQQYDSSPYTFGQGTKVEIK

SEQ ID NO: 1003 - DNA, 372 bp, Homo sapiens
caggtacagctgcagcagtcaggggctgaggtgaagaagcctgggtcctcggtgaaggtctcctgcacgtcctctgaagtcaccttcagtagttttgctatcagctgggtgcgacaggcccctggacaagggcttgagtggctgggagggatcagccctatgtttggaacacctaattacgcgcagaagttccaaggcagagtcaccattaccgcggaccagtccacgaggacagcctacatggacctgaggagcctgagatctgaggacacggccgtgtattattgtgcgagatctccttcttacatttgttctggtggaacctgcgtctttgaccattggggccagggaaccctggtcaccgtctcctca

SEQ ID NO: 1004 - protein, 122 aa, Homo sapiens
QVQLVQSGAEVKKPGASVKVSCKTSGVTFSSYAISWVRQAPGQGLEWMGGIIGVFGVPKYAQNFQGRVTITADKPTSTVYMELNSLRAEDTAVYYCAREPGYYVGKNGFDVWGQGTMVTVSS

SEQ ID NO: 1005 - DNA, 330 bp, Homo sapiens
cagcctgggctgactcagccaccctcggtgtccaagggcttgagacagaccgccacactcacctgcactgggaacagcaacaatgttggcaaccaaggagcagcttggctgcagcagcaccagggccaccctcccaaactcctatcctacaggaataatgaccggccctcagggatctcagagagattctctgcatccaggtcaggaaacacagcctccctgaccattactggactccagcctgaggacgaggctgactattactgctcaacatgggacagcagcctcagtgctgtggtattcggcggagggaccaagctgaccgtccta

SEQ ID NO: 1006 - protein, 110 aa, Homo sapiens
SYELTQPPSVSKGLRQTAILTCTGDSNNVGHQGTAWLQQHQGHPPKLLSYRNGNRPSGISERFSASRSGNTASLTIIGLQPEDEADYYCSVWDSSLSAWVFGGGTKLTVL

SEQ ID NO: 1007 - DNA, 321 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagaggggtcccatcaaggttcagtggcagtggatctgggacagacttcactctcaccattagcagcctgcagcctgaagattttgcagtgtattactgtcagcagtatgatagttcaccgtacacttttggccaggggaccaaggtagagatcaaa

SEQ ID NO: 1008 - protein, 126 aa, Homo sapiens
QVQLVQSGAEVRKPGASVKVSCKASGYTFTGYYIHWVRQAPGQGLEWMGWINPMTGGTNYAQKFQVWVTMTRDTSINTAYMEVSRLTSDDTAVYYCARGASVLRYFDWQPEALDIWGLGTTVTVSS

SEQ ID NO: 1009 - DNA, 366 bp, Homo sapiens
caggtgcagctggtgcaatctggggctgaagtgaagaagcctggggcctcagtgaaggtctcctgcaagacttctggagtcaccttcagcagctatgctatcagttgggtgcgacaggcccctggacaagggcttgagtggatgggagggatcatcggtgtctttggtgtaccaaagtacgcgcagaacttccagggcagagtcacaattaccgcggacaaaccgacgagtacagtctacatggagctgaacagcctgagagctgaggacacggccgtgtattactgtgcgagagagcccgggtactacgtaggaaagaatggttttgatgtctggggccaagggacaatggtcaccgtctcttca

SEQ ID NO: 1010 - protein, 108 aa, Homo sapiens
QPVLTQPPSVSVAPGQTASIPCGGNNIGGYSVHWYQQKPGQAPLLVIYDDKDRPSGIPERFSGANSGSTATLTISRVEAGDEGDYYCQVWDSGNDRPLFGGGTKLTVL

SEQ ID NO: 1011 - DNA, 330 bp, Homo sapiens
tcctatgagctgactcagccaccctcggtgtccaagggcttgagacagaccgccatactcacctgcactggagacagcaacaatgttggccaccaaggtacagcttggctgcaacaacaccagggccaccctcccaaactcctatcctacaggaatggcaaccggccctcagggatctcagagagattctctgcatccaggtcaggaaatacagcctccctgaccattattggactccagcctgaggacgaggctgactactactgctcagtatgggacagcagcctcagtgcctgggtgttcggcggagggaccaagctgaccgtccta

SEQ ID NO: 1012 - protein, 123 aa, Homo sapiens
QVQLVQSGAEVKKPGSSVKVSCKASGGPFSMTAFTWLRQAPGQGLEWMGGISPIFRTPKYAQKFQGRVTITADESTNTANMELTSLKSEDTAVYYCARTLSSYQPNNDAFAIWGQGTMVTVSS

SEQ ID NO: 1013 - DNA, 378 bp, Homo sapiens
caggtgcagctggtgcagtctggggctgaggtgaggaagcctggggcctcagtgaaggtctcatgtaaggcttctggatacaccttcaccggttattatattcactgggtgcgacaggcccctggacaaggacttgagtggatgggttggatcaaccctatgactggtggcacaaactatgcacagaagtttcaggtctgggtcaccatgacccgggacacgtccatcaacacagcctacatggaggtgagcaggctgacatctgacgacacggccgtgtattactgtgcgaggggggcttccgtattacgatattttgactggcagcccgaggctcttgatatctggggcctcgggaccacggtcaccgtctcctca

SEQ ID NO: 1014 - protein, 106 aa, Homo sapiens
EIVLTQSPATLSLSPGERATLSCRASQSVSSYLAWYQQKPGQAPRLLIYDASNRATGIPARFSGSGSGTDFTLTISRLEPEDFAVYFCQQYGSSPQFGQGTRLEIK

SEQ ID NO: 1015 - DNA, 324 bp, Homo sapiens
cagcctgtgctgactcagccaccctcggtgtcagtggccccaggacagacggccagcattccctgtggggggaacaacattggaggctacagtgtacactggtaccaacaaaagccgggccaggcccccctcttggtcatttatgacgataaagaccggccctcagggatccctgagcgattctctggcgccaactctgggagcacggccaccctgacaatcagcagggtcgaagccggggatgagggcgactactactgtcaggtgtgggatagtggtaatgatcgtccgctgttcggcggagggaccaagctgaccgtccta

SEQ ID NO: 1016 - protein, 123 aa, Homo sapiens; identical to SEQ ID NO: 1012

SEQ ID NO: 1017 - DNA, 369 bp, Homo sapiens
caggtgcagctggtgcagtctggggctgaagtgaagaagcctggctcctcggtgaaggtttcctgcaaggcttctggaggccccttcagcatgactgctttcacctggctgcgacaggcccctggacaagggcttgagtggatgggtgggatcagccctatctttcgtacaccgaagtacgcacagaagttccagggcagagtcacgattaccgcggacgaatccacgaacacagccaacatggagctgaccagcctgaaatctgaggacacggccgtgtattactgtgcgagaaccctttcctcctaccaaccgaataatgatgcttttgctatctggggccaagggacaatggtcaccgtctcttca

SEQ ID NO: 1018 - protein, 110 aa, Homo sapiens
LPVLTQPPSASGTPGQRVTISCSGSSSNIGSNTVNWYQQLPGTAPKLLIYSNNQRPSGVPDRFSGSRSGTSASLAIIGLRPEDEADYYCQSYDSRLSASLFGTGTTVTVL

SEQ ID NO: 1019 - DNA, 318 bp, Homo sapiens
gaaattgtgttgacgcagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagactggagcctgaagattttgcagtctatttctgtcagcagtatggtagctcacctcaattcggccaagggacacgactggagattaaa

SEQ ID NO: 1020 - DNA, 369 bp, Homo sapiens; identical to SEQ ID NO: 1017

SEQ ID NO: 1021 - skipped

SEQ ID NO: 1022 - DNA, 330 bp, Homo sapiens
ctgcctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaggtcaggcacctcagcctccctggccatcattggactccggcctgaggatgaagctgattattactgtcagtcgtatgacagcaggctcagtgcttctctcttcggaactgggaccacggtcaccgtcctc

SEQ ID NO: 1023 - protein, 5 aa, Artificial Sequence
  Description of Artificial Sequence: Synthetic Consensus sequence
SYAFS

SEQ ID NO: 1024 - protein, 5 aa, Homo sapiens
TNAFS

SEQ ID NO: 1025 - protein, 5 aa, Homo sapiens
AYAFT

SEQ ID NO: 1026 - protein, 5 aa, Homo sapiens
SFAIS

SEQ ID NO: 1027 - protein, 5 aa, Homo sapiens
SYAIS

SEQ ID NO: 1028 - protein, 5 aa, Homo sapiens
GYYIH

SEQ ID NO: 1029 - protein, 5 aa, Homo sapiens
MTAFT

SEQ ID NO: 1030 - protein, 5 aa, Homo sapiens
DNAIS

SEQ ID NO: 1031 - protein, 17 aa, Artificial Sequence
  Description of Artificial Sequence: Synthetic Consensus sequence
GIIPMFGTPNYAQKFQG

SEQ ID NO: 1032 - protein, 17 aa, Homo sapiens
GVIPLFRTASYAQNVQG

SEQ ID NO: 1033 - protein, 17 aa, Homo sapiens
GIIGMFGTANYAQKFQG

SEQ ID NO: 1034 - protein, 17 aa, Homo sapiens
GISPMFGTPNYAQKFQG

SEQ ID NO: 1035 - protein, 17 aa, Homo sapiens
GIIGVFGVPKYAQKFQG

SEQ ID NO: 1036 - protein, 17 aa, Homo sapiens
WINPMTGGTNYAQKFQV

SEQ ID NO: 1037 - protein, 17 aa, Homo sapiens
GISPIFRTPKYAQKFQG

SEQ ID NO: 1038 - protein, 17 aa, Homo sapiens
GIIPIFGKPNYAQKFQG

SEQ ID NO: 1039 - protein, 12 aa, Artificial Sequence
  Description of Artificial Sequence: Synthetic Consensus sequence
SSGYYYGGGFDV

SEQ ID NO: 1040 - protein, 13 aa, Homo sapiens
SSGYHFGRSHFDS

SEQ ID NO: 1041 - protein, 11 aa, Homo sapiens
GLYYYESSLDY

SEQ ID NO: 1042 - protein, 15 aa, Homo sapiens
SPSYICSGGTCVFDH

SEQ ID NO: 1043 - protein, 13 aa, Homo sapiens
EPGYYVGKNGFDV

SEQ ID NO: 1044 - protein, 17 aa, Homo sapiens
GASVLRYFDWQPEALDI

SEQ ID NO: 1045 - protein, 14 aa, Homo sapiens
TLSSYQPNNDAFAI

SEQ ID NO: 1046 - protein, 14 aa, Homo sapiens
DSDAYYYGSGGMDV

SEQ ID NO: 1047 - protein, 12 aa, Homo sapiens
TGSSSNIGNYVA

SEQ ID NO: 1048 - protein, 13 aa, Homo sapiens
TGSSSNIAANYVQ

SEQ ID NO: 1049 - protein, 14 aa, Artificial Sequence
  Description of Artificial Sequence: Synthetic Consensus sequence
TGTSSDVGGYNSVS

SEQ ID NO: 1050 - protein, 13 aa, Homo sapiens
TGNSNNVGNQGAA

SEQ ID NO: 1051 - protein, 13 aa, Homo sapiens
TGDSNNVGHQGTA

SEQ ID NO: 1052 - protein, 11 aa, Homo sapiens
GGNNIGGYSVH

SEQ ID NO: 1053 - protein, 11 aa, Homo sapiens
RASQSVSSYLA

SEQ ID NO: 1054 - protein, 12 aa, Homo sapiens
RASQSLSSKYLA

SEQ ID NO: 1055 - protein, 12 aa, Homo sapiens
TGSSSNIGNYVA

SEQ ID NO: 1056 - protein, 13 aa, Homo sapiens
SGSSSNIGSNTVN

SEQ ID NO: 1057 - protein, 11 aa, Homo sapiens
RASQSISSYLN

SEQ ID NO: 1058 - protein, 12 aa, Homo sapiens
TLSSGHSNYIIA

SEQ ID NO: 1059 - protein, 7 aa, Artificial Sequence
  Description of Artificial Sequence: Synthetic Consensus sequence
SNSDRPS

SEQ ID NO: 1060 - protein, 7 aa, Homo sapiens
EDDRRPS

SEQ ID NO: 1061 - protein, 7 aa, Homo sapiens
EVTKRPS

SEQ ID NO: 1062 - protein, 7 aa, Homo sapiens
RNNDRPS

SEQ ID NO: 1063 - protein, 7 aa, Homo sapiens
RNGNRPS

SEQ ID NO: 1064 - protein, 7 aa, Homo sapiens
DDKDRPS

SEQ ID NO: 1065 - protein, 7 aa, Homo sapiens
DASNRAT

SEQ ID NO: 1066 - protein, 7 aa, Homo sapiens
GASSRAT

SEQ ID NO: 1067 - protein, 7 aa, Homo sapiens
SNNQRPS

SEQ ID NO: 1068 - protein, 7 aa, Homo sapiens
AASSLQR

SEQ ID NO: 1069 - protein, 7 aa, Homo sapiens
SNEQRPS

SEQ ID NO: 1070 - protein, 11 aa, Homo sapiens
VNSDGSHTKGD

SEQ ID NO: 1071 - protein, 10 aa, Artificial Sequence
  Description of Artificial Sequence: Synthetic Consensus sequence
QSYDSLSAYV

SEQ ID NO: 1072 - protein, 10 aa, Homo sapiens
QSYDTNNHAV

SEQ ID NO: 1073 - protein, 10 aa, Homo sapiens
CSYAGHSAYV

SEQ ID NO: 1074 - protein, 11 aa, Homo sapiens
STWDSSLSAVV

SEQ ID NO: 1075 - protein, 11 aa, Homo sapiens
SVWDSSLSAWV

SEQ ID NO: 1076 - protein, 11 aa, Homo sapiens
QVWDSGNDRPL

SEQ ID NO: 1077 - protein, 9 aa, Homo sapiens
QQYGSSPQV

SEQ ID NO: 1078 - protein, 9 aa, Homo sapiens
QQYDGVPRT

SEQ ID NO: 1079 - protein, 11 aa, Homo sapiens
QSYDSRLSASL

SEQ ID NO: 1080 - protein, 9 aa, Homo sapiens
QQYDSSPYT

SEQ ID NO: 1081 - protein, 11 aa, Homo sapiens
ASWDDNLSGWV

SEQ ID NO: 1082 - protein, 9 aa, Homo sapiens
ETWDTKIHV

SEQ ID NO: 1083 - protein, 10 aa, Artificial Sequence
  Description of Artificial Sequence: Synthetic peptide
GTETSQVAPA

SEQ ID NO: 1084 - protein, 6 aa, Artificial Sequence
  Description of Artificial Sequence: Synthetic 6xHis tag
HHHHHH

SEQ ID NO: 1085 - protein, 4 aa, Influenza A virus
INGW

SEQ ID NO: 1086 - protein, 4 aa, Influenza A virus
IDGW

SEQ ID NO: 1087 - protein, 4 aa, Influenza A virus
VAGW

SEQ ID NO: 1088 - protein, 4 aa, Influenza A virus
VDGW

SEQ ID NO: 1089 - protein, 4 aa, Influenza A virus
IAGW

SEQ ID NO: 1090 - protein, 87 aa, Homo sapiens
KKPGSSVKVSCKASGGTFSSYAISWVRQAPGQGLEWMGGIIPMFGTPNYAQKFQGRVTITADESTSTAYMELSSLRSEDTAVYYCAR

SEQ ID NO: 1091 - protein, 87 aa, Homo sapiens
KKPGSSVKVSCKASGGTFSSYAISWVRQAPGQGLEWMGGIIPIFGTPNYAQKFQGRVTITADESTSTAYMELSSLRSEDTAVYYCAR

SEQ ID NO: 1092 - protein, 108 aa, Homo sapiens
KKPGSSVKVSCTSSEVTFSSFAISWVRQAPGQGLEWLGGISPMFGTPNYAQKFQGRVTITADQSTRTAYMDLRSLRSEDTAVYYCARSPSYICSGGTCVFDHWGQGTL

SEQ ID NO: 1093 - protein, 104 aa, Homo sapiens
KKPGSSVKVSCKASGGTFSAYAFTWVRQAPGQGLEWMGGIIGMFGTANYAQKFQGRVTITADELTSTAYMELSSLTSEDTALYYCARGLYYYESSFDYWGQGTL

SEQ ID NO: 1094 - protein, 107 aa, Homo sapiens
KKPGSSVKVSCKASGGPFSMTAFTWLRQAPGQGLEWMGGISPIFRTPKYAQKFQGRVTITADESTNTANMELTSLKSEDTAVYYCARTLSSYQPNNDAFAIWGQGTM

SEQ ID NO: 1095 - protein, 106 aa, Homo sapiens
KKPGASVKVSCKTSGVTFSSYAISWVRQAPGQGLEWMGGIIGVFGVPKYAQKFQGRVTITADKPTSTVYMELNSLRAEDTAVYYCAREPGYYVGKNGFDVWGQGTM

SEQ ID NO: 1096 - protein, 105 aa, Homo sapiens
KKPGSSVKVSCKAPGGIFNTNAFSWVRQAPGQGLEWVGGVIPLFRTASYAQNVQGRVTITADESTNTAYMELTSLRSADTAVYYCARSSGYHFRSHFDSWGLGTL

SEQ ID NO: 1097 - protein, 110 aa, Homo sapiens
RKPGASVKVSCKASGYTFTGYYIHWVRQAPGQGLEWMGWINPMTGGTNYAQKFQVWVTMTRDTSINTAYMEVTRLTSDDTAVYYCARGASVLRYFDWQPEALDIWGLGTT

SEQ ID NO: 1098 - protein, 8 aa, Homo sapiens
GGTFSSYA

SEQ ID NO: 1099 - protein, 8 aa, Homo sapiens
GGTFSSYA

SEQ ID NO: 1100 - protein, 8 aa, Homo sapiens
EVTFSSFA

SEQ ID NO: 1101 - protein, 8 aa, Homo sapiens
GGTFSAYA

SEQ ID NO: 1102 - protein, 8 aa, Homo sapiens
GGPFSMTA

SEQ ID NO: 1103 - protein, 8 aa, Homo sapiens
GVTFSSYA

SEQ ID NO: 1104 - protein, 8 aa, Homo sapiens
GGIFNTNA

SEQ ID NO: 1105 - protein, 8 aa, Homo sapiens
GYTFTGYY

SEQ ID NO: 1106 - protein, 8 aa, Homo sapiens
IIPMFGTP

SEQ ID NO: 1107 - protein, 8 aa, Homo sapiens
IIPIFGTP

SEQ ID NO: 1108 - protein, 8 aa, Homo sapiens
ISPMFGTP

SEQ ID NO: 1109 - protein, 8 aa, Homo sapiens
IIGMFGTA

SEQ ID NO: 1110 - protein, 8 aa, Homo sapiens
ISPIFRTP

SEQ ID NO: 1111 - protein, 8 aa, Homo sapiens
IIGVFGVP

SEQ ID NO: 1112 - protein, 8 aa, Homo sapiens
VIPLFRTA

SEQ ID NO: 1113 - protein, 8 aa, Homo sapiens
INPMTGGT

SEQ ID NO: 1114 - protein, 17 aa, Homo sapiens
ARSPSYICSGGTCVFDH

SEQ ID NO: 1115 - protein, 13 aa, Homo sapiens
ARGLYYYESSFDY

SEQ ID NO: 1116 - protein, 16 aa, Homo sapiens
ARTLSSYQPNNDAFAI

SEQ ID NO: 1117 - protein, 15 aa, Homo sapiens
AREPGYYVGKNGFDV

SEQ ID NO: 1118 - protein, 14 aa, Homo sapiens
ARSSGYHFRSHFDS

SEQ ID NO: 1119 - protein, 19 aa, Homo sapiens
ARGASVLRYFDWQPEALDI

SEQ ID NO: 1120 - protein, 8 aa, Homo sapiens
SGNIAANY

SEQ ID NO: 1121 - protein, 9 aa, Homo sapiens
SSDVGGYNS

SEQ ID NO: 1122 - protein, 8 aa, Homo sapiens
SNNVGNQG

SEQ ID NO: 1123 - protein, 8 aa, Homo sapiens
SNNVGHQG

SEQ ID NO: 1124 - protein, 6 aa, Homo sapiens
NIGGYS

SEQ ID NO: 1125 - protein, 7 aa, Homo sapiens
QSSVSSY

SEQ ID NO: 1126 - protein, 7 aa, Homo sapiens
QSLSSKY

SEQ ID NO: 1127 - protein, 8 aa, Homo sapiens
SSNIGSNT

SEQ ID NO: 1128 - protein, 6 aa, Homo sapiens
QSISSY

SEQ ID NO: 1129 - protein, 8 aa, Homo sapiens
TSNIGRNH

SEQ ID NO: 1130 - protein, 3 aa, Homo sapiens
EDD

SEQ ID NO: 1131 - protein, 3 aa, Homo sapiens
EVT

SEQ ID NO: 1132 - protein, 3 aa, Homo sapiens
RNN

SEQ ID NO: 1133 - protein, 3 aa, Homo sapiens
RNG

SEQ ID NO: 1134 - protein, 3 aa, Homo sapiens
DDK

SEQ ID NO: 1135 - protein, 3 aa, Homo sapiens
DAS

SEQ ID NO: 1136 - protein, 3 aa, Homo sapiens
GAS

SEQ ID NO: 1137 - protein, 3 aa, Homo sapiens
SNN

SEQ ID NO: 1138 - protein, 3 aa, Homo sapiens
AAS

SEQ ID NO: 1139 - protein, 3 aa, Homo sapiens
SNE

SEQ ID NO: 1140 - protein, 10 aa, Homo sapiens
QTYDTNNHAV

SEQ ID NO: 1141 - protein, 10 aa, Homo sapiens
CSYAGHSAYV

SEQ ID NO: 1142 - protein, 11 aa, Homo sapiens
STWDSSLSAVV

SEQ ID NO: 1143 - protein, 11 aa, Homo sapiens
SVWDSSLSAWV

SEQ ID NO: 1144 - protein, 11 aa, Homo sapiens
QVWDSGNDRPL

SEQ ID NO: 1145 - protein, 8 aa, Homo sapiens
QQYGSSPQ

SEQ ID NO: 1146 - protein, 9 aa, Homo sapiens
QQYDGVPRT

SEQ ID NO: 1147 - protein, 11 aa, Homo sapiens
QSYDSRLSASL

SEQ ID NO: 1148 - protein, 9 aa, Homo sapiens
QQYDSSPYT

SEQ ID NO: 1149 - protein, 11 aa, Homo sapiens
ASWDDNLSGWV

SEQ ID NO: 1150 - protein, 2 aa, Homo sapiens
AR

SEQ ID NO: 1151 - protein, 10 aa, Homo sapiens
QVQLVQGAEV

SEQ ID NO: 1152 - protein, 5 aa, Homo sapiens
VTVSS

SEQ ID NO: 1153 - DNA, 354 bp, Homo sapiens
caggtccagctcgtccagtccggcgctgaagtggtgaaacccggggcatccgtcaaagtctcttgtaaggctagtggctacaccttcacatcctactggatgcattgggtgaaacaggcacctggccagggactcgaatggatcggagccgtgtctcctggaaattccgacacctcctacaacgaaaaattcaagggcaaggcaaccctcactgtggatactagtgcttctaccgcctacatggaactctcatctctccgctctgaggacactgccgtctactactgtactcggtcacgatacgggaacaacgctctcgattactggggacagggcacactggtcactgtctct

SEQ ID NO: 1154 - protein, 118 aa, Homo sapiens
QVQLVQSGAEVVKPGASVKVSCKASGYTFTSYWMHWVKQAPGQGLEWIGAVSPGNSDTSYNEKFKGKATLTVDTSASTAYMELSSLRSEDTAVYYCTRSRYGNNALDYWGQGTLVTVS

SEQ ID NO: 1155 - DNA, 321 bp, Homo sapiens
gatattcagctcacacagagcccatcttctctgtctgcttctgtgggcgatcgagtgacaatcacttgtcgggctagtcagggcatttctagcaacattgtgtggctccagcagaaacctggcaaagccccaaaaggcctcatctaccacggaaccaacctggaatctggcgtgccatctcggtttagtggatctggatccgggaccgattacacactcaccatctcttcactggaacctgaggatttcgccacctactactgtgtccagtactcccagtttccacccacttttggacagggaaccaaactcgagatcaaa

SEQ ID NO: 1156 - protein, 107 aa, Homo sapiens
DIQLTQSPSSLSASVGDRVTITCRASQGISSNIVWLQQKPGKAPKGLIYHGTNLESGVPSRFSGSGSGTDYTLTISSLEPEDFATYYCVQYSQFPPTFGQGTKLEIK

SEQ ID NO: 1157 - protein, 8 aa, Homo sapiens
GYTFTSYW

SEQ ID NO: 1158 - protein, 8 aa, Homo sapiens
VSPGNSDT

SEQ ID NO: 1159 - protein, 12 aa, Homo sapiens
TRSRYGNNALDY

SEQ ID NO: 1160 - protein, 9 aa, Homo sapiens
QGISSNIVW

SEQ ID NO: 1161 - protein, 3 aa, Homo sapiens
HGT

SEQ ID NO: 1162 - protein, 9 aa, Homo sapiens
VQYSQFPPT

SEQ ID NO: 1163 - DNA, 354 bp, Homo sapiens
caggtccagctcgtccagtccggcgctgaagtggtgaaacccggggcatccgtcaaagtctcttgtaaggctagtggctacaccttcacatcctactggatgcattgggtgaaacaggcacctggccagggactcgaatggatcggagccgtgtctcctggaaattccgacacctcctacaacgaaaaattcaagggcaaggcaaccctcactgtggacaaatctgcctctaccgcctacatggaactctcatctctccgctctgaggatactgctgtgtactactgtacccggtcacgatacggcaataacgccctcgattactgggggcagggaactctggtcactgtgtct

SEQ ID NO: 1164 - protein, 118 aa, Homo sapiens
QVQLVQSGAEVVKPGASVKVSCKASGYTFTSYWMHWVKQAPGQGLEWIGAVSPGNSDTSYNEKFKGKATLTVDKSASTAYMELSSLRSEDTAVYYCTRSRYGNNALDYWGQGTLVTVS

SEQ ID NO: 1165 - DNA, 357 bp, Mus musculus
caggtccagctgcagcagtctgggactgtgctcgcaaggcctggggcttcagtgaagatgtcctgcaaggcttctggctacacctttaccagttactggatgcactgggtaaaacagaggcctggacagggtctggaatggattggcgctgtttctcctggaaatagtgatactagctacaaccagaagttcaagggcaaggccacactgactgcagtcacatccaccagcactgcctacatggagttcagcagcctgacaaatgaggactctgcggtctattactgtacaagaagtcgatatggtaacaatgctttggactactggggccaagggaccacggtcaccgtctcctca

SEQ ID NO: 1166 - protein, 119 aa, Mus musculus
QVQLQQSGTVLARPGASVKMSCKASGYTFTSYWMHWVKQRPGQGLEWIGAVSPGNSDTSYNQKFKGKATLTAVTSTSTAYMEFSSLTNEDSAVYYCTRSRYGNNALDYWGQGTTVTVSS

SEQ ID NO: 1167 - DNA, 330 bp, Mus musculus
gacatcgagctcacccagtctcctgcttccttagctgtatctctggggcagagggccaccatctcatacagggccagcaaaagtgtcagtacatctggctatagttatatgcactggaaccaacagaaaccaggacagccacccagactcctcatctatcttgtatccaacctagaatctggggtccctgccaggttcagtggcagtgggtctgggacagacttcaccctcaacatccatcctgtggaggaggaggatgctgcaacctattactgtcagcacattaagggagcttacacgttcggaggggggaccaagctggaaataaaa

SEQ ID NO: 1168 - DNA, 330 bp, Mus musculus
gacatcgagctcactcagtctccagcttctttggctgtgtctctagggcagagggccaccatctcctgcagagccagcgcaagtgttgataattatggcattagttttatgaactggttccaacagaaaccaggacagccacccaaactcctcatctatgctgcatccaaccaaggatccggggtccctgccaggtttagtggcagtgggtctgggacagacttcagcctcaacatccatcctatggaggaggatgatactgcaacctattactgtcagcacattaagggagcttacacgttcggaggggggaccaagctggagctgaaa

SEQ ID NO: 1169 - DNA, 321 bp, Mus musculus
gacatcgagctcactcagtctccatcctccatgtctgtatctctgggagacacagtcaacatcacttgccgtgcaagtcagggcattagcagtaatatagtgtggttgcagcagaaaccagggaagtcatttaagggcctgatctatcatgggaccaatttggaagatggagttccatcaaggttcagtggcagtggatctggagccgattattctctcaccatcagcagcctggaatctgaggattttgcagactattactgtgtacagtattctcagtttcctcccacgttcggctcggggaccaagctggagctgaaa

SEQ ID NO: 1170 - protein, 107 aa, Mus musculus
DIELTQSPSSMSVSLGDTVNITCRASQGISSNIVWLQQKPGKSFKGLIYHGTNLEDGVPSRFSGSGSGADYSLTISSLESEDFADYYCVQYSQFPPTFGSGTKLELK

SEQ ID NO: 1171 - protein, 118 aa, Homo sapiens; identical to SEQ ID NO: 1164

SEQ ID NO: 1172 - protein, 118 aa, Mus musculus
QVQLQQSGTVLARPGASVKMSCKASGYTFTSYWMHWVKQRPGQGLEWIGAVSPGNSDTSYNQKFKGKATLTAVTSTSTAYMEFSSLTNEDSAVYYCTRSRYGNNALDYWGQGTTVTVS

SEQ ID NO: 1173 - protein, 107 aa, Homo sapiens
DIQMTQSPSSLSASVGDRVTITCRASQGISSNIVWYQQKPGKAPKGLIYHGTNLESGVPSRFSGSGSGTDYTLTISSLQPEDFATYYCVQYSQFPPTFGQGTKLEIK

SEQ ID NO: 1174 - protein, 98 aa, Homo sapiens
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCAR

SEQ ID NO: 1175 - DNA, 294 bp, Homo sapiens
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgaga

SEQ ID NO: 1176 - protein, 8 aa, Artificial Sequence
  Description of Artificial Sequence: Synthetic Chemically synthesized peptide
ISPMFGTP

SEQ ID NO: 1177 - protein, 8 aa, Artificial Sequence
  Description of Artificial Sequence: Synthetic Chemically synthesized peptide
IIPIFGTA

SEQ ID NO: 1178 - protein, 8 aa, Artificial Sequence
  Description of Artificial Sequence: Synthetic Chemically synthesized peptide
ISPIFGTA

SEQ ID NO: 1179 - protein, 8 aa, Artificial Sequence
  Description of Artificial Sequence: Synthetic Chemically synthesized peptide
  MOD_RES (2)..(2): Isoleucine or Serine
  MOD_RES (4)..(4): Isoleucine or Methionine
IXPXFGTA

SEQ ID NO: 1180 - protein, 8 aa, Artificial Sequence
  Description of Artificial Sequence: Synthetic Chemically synthesized peptide
  MOD_RES (1)..(1): Glycine or Glutamic acid
  MOD_RES (2)..(2): Glycine or Valine
XXTFSSYA

SEQ ID NO: 1181 - protein, 8 aa, Artificial Sequence
  Description of Artificial Sequence: Synthetic Chemically synthesized peptide
  MOD_RES (2)..(2): Isoleucine or Serine
  MOD_RES (4)..(4): Isoleucine or Methionine
IXPXFGTA

SEQ ID NO: 1182 - DNA, 354 bp, Artificial Sequence
  Description of Artificial Sequence: Synthetic Variable heavy chain
caggtgcagctggtgcagagcggagccgaggtgaagaagcctggagcttccgtcaaggtgtcctgcaaggccagcggctacaccttcgccagccaatggatgcactggatgcggcaggcacctggacagggcctcgaatggatcggctggatcaaccccggcaacgtgaacaccaagtacaacgagaagttcaagggcagggccaccctgaccgtggacaccagcaccaacaccgcctacatggaactgagcagcctgcggagcgaggacaccgccgtgtactactgcgccagaagcacctggtaccggccgctggactactggggccagggcaccctggtgaccgtgagcagc

SEQ ID NO: 1183 - protein, 118 aa, Artificial Sequence
  Description of Artificial Sequence: Synthetic Variable heavy chain
QVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSS

SEQ ID NO: 1184 - DNA, 336 bp, Artificial Sequence
  Description of Artificial Sequence: Synthetic Variable light chain
gacatcgtgatgacccagagccccgacagcctggccgtgagcctgggcgagcgggccaccatcaactgcaagagcagccagagcatcctgtacagcagcaaccagaagaactacctggcctggtatcagcagaagcccggccagagccccaagctgctgatctactgggccagcacccgggagagcggcgtgcccgaccggtttagcggcagcggctccggcaccgacttcaccctgaccatcagcagcctgcaggccgaggacgtggccgtgtactactgccaccagtacatcagcagctacaccttcggccagggcacaaagctggaaatcaag

SEQ ID NO: 1185 - protein, 112 aa, Artificial Sequence
  Description of Artificial Sequence: Synthetic Variable light chain
DIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIK

SEQ ID NO: 1186 - DNA, 354 bp, Artificial Sequence
  Description of Artificial Sequence: Synthetic Variable heavy chain
caggtgcagctggtgcagagcggagccgaggtgaagaagcctggagcttccgtcaaggtgtcctgcaaggccagcggctacaccttcgccagcagctggatgcactggatgcggcaggcacctggacagggcctcgaatggatcggctggatcaaccccggcaacgtgaacaccaagtacaacgagaagttcaagggcagggccaccctgaccgtggacaccagcaccaacaccgcctacatggaactgagcagcctgcggagcgaggacaccgccgtgtactactgcgccagaagcacgtggtatcggccgaatgactactggggccagggcaccctggtgaccgtgagcagc

SEQ ID NO: 1187 - protein, 118 aa, Artificial Sequence
  Description of Artificial Sequence: Synthetic Variable heavy chain
QVQLVQSGAEVKKPGASVKVSCKASGYTFASSWMHWMRQAPGQGLEWIGWINPGNVNTKYNEKFKGRATLTVDTSTNTAYMELSSLRSEDTAVYYCARSTWYRPNDYWGQGTLVTVSS

SEQ ID NO: 1188 - DNA, 336 bp, Artificial Sequence
  Description of Artificial Sequence: Synthetic Variable light chain
gacatcgtgatgacccagagccccgacagcctggccgtgagcctgggcgagcgggccaccatcaactgcaagagcagccagagcatcctgtacagcagcaaccagaagaactacctggcctggtatcagcagaagcccggccagagccccaagctgctgatctactgggccagcacccgggagagcggcgtgcccgaccggtttagcggcagcggctccggcaccgacttcaccctgaccatcagcagcctgcaggccgaggacgtggccgtgtactactgccaccagtacaaaagcagctacaccttcggccagggcacaaagctggaaatcaag

SEQ ID NO: 1189 - protein, 112 aa, Artificial Sequence
  Description of Artificial Sequence: Synthetic Variable light chain
DIVMTQSPDSLAVSLGERATINCKSSQSILYSSNQKNYLAWYQQKPGQSPKLLIYWASTRESGVPDRFSGSGSGTDFTLTISSLQAEDVAVYYCHQYKSSYTFGQGTKLEIK

SEQ ID NO: 1190 - DNA, 354 bp, Artificial Sequence
  Description of Artificial Sequence: Synthetic Variable heavy chain
caggtgcagctggtgcagagcggagccgaggtgaagaagcctggagcttccgtcaaggtgtcctgcaaggccagcggctacaccttcgccagcagctggatgcactggatgcggcaggcacctggacagggcctcgaatggatcggctggatcaaccccggcaacgtgaacaccaagtacaacgagaagttcaagggcagggccaccctgaccgtggacaccagcaccaacaccgcctacatggaactgagcagcctgcggagcgaggacaccgccgtgtactactgcgccagaaccacccgttatcggcccctggactactggggccagggcaccctggtgaccgtgagcagc

SEQ ID NO: 1191 - protein, 118 aa, Artificial Sequence
  Description of Artificial Sequence: Synthetic Variable heavy chain
QVQLVQSGAEVKKPGASVKVSCKASGYTFASSWMHWMRQAPGQGLEWIGWINPGNVNTKYNEKFKGRATLTVDTSTNTAYMELSSLRSEDTAVYYCARTTRYRPLDYWGQGTLVTVSS

SEQ ID NO: 1192 - DNA, 336 bp, Artificial Sequence
  Description of Artificial Sequence: Synthetic Variable light chain
gacatcgtgatgacccagagccccgacagcctggccgtgagcctgggcgagcgggccaccatcaactgcaagagcagccagagcatcctgtacagcagcaaccagaagaactacctggcctggtatcagcagaagcccggccagagccccaagctgctgatctactgggccagcacccgggagagcggcgtgcccgaccggtttagcggcagcggctccggcaccgacttcaccctgaccatcagcagcctgcaggccgaggacgtggccgtgtactactgccaccagtaccgtagcagctacaccttcggccagggcacaaagctggaaatcaag

SEQ ID NO: 1193 - protein, 112 aa, Artificial Sequence
  Description of Artificial Sequence: Synthetic Variable light chain
DIVMTQSPDSLAVSLGERATINCKSSQSILYSSNQKNYLAWYQQKPGQSPKLLIYWASTRESGVPDRFSGSGSGTDFTLTISSLQAEDVAVYYCHQYRSSYTFGQGTKLEIK

SEQ ID NO: 1194 - DNA, 354 bp, Artificial Sequence
  Description of Artificial Sequence: Synthetic Variable heavy chain
caggtgcagctggtgcagagcggagccgaggtgaagaagcctggagcttccgtcaaggtgtcctgcaaggccagcggctacaccttcgccagccaatatatgcactggatgcggcaggcacctggacagggcctcgaatggatcggctggatcaaccccggcaacgtgaacaccaagtacaacgagaagttcaagggcagggccaccctgaccgtggacaccagcaccaacaccgcctacatggaactgagcagcctgcggagcgaggacaccgccgtgtactactgcgccagactgacctattatcggccgccggactactggggccagggcaccctggtgaccgtgagcagc

SEQ ID NO: 1195 - protein, 118 aa, Artificial Sequence
  Description of Artificial Sequence: Synthetic Variable heavy chain
QVQLVQSGAEVKKPGASVKVSCKASGYTFASQYMHWMRQAPGQGLEWIGWINPGNVNTKYNEKFKGRATLTVDTSTNTAYMELSSLRSEDTAVYYCARLTYYRPPDYWGQGTLVTVSS

SEQ ID NO: 1196 - DNA, 336 bp, Artificial Sequence
  Description of Artificial Sequence: Synthetic Variable light chain
gacatcgtgatgacccagagccccgacagcctggccgtgagcctgggcgagcgggccaccatcaactgcaagagcagccagagcatcctgtacagcagcaaccagaagaactacctggcctggtatcagcagaagcccggccagagccccaagctgctgatctactgggccagcacccgggagagcggcgtgcccgaccggtttagcggcagcggctccggcaccgacttcaccctgaccatcagcagcctgcaggccgaggacgtggccgtgtactactgccaccagtactatagcagctacaccttcggccagggcacaaagctggaaatcaag

SEQ ID NO: 1197 - protein, 112 aa, Artificial Sequence
  Description of Artificial Sequence: Synthetic Variable light chain
DIVMTQSPDSLAVSLGERATINCKSSQSILYSSNQKNYLAWYQQKPGQSPKLLIYWASTRESGVPDRFSGSGSGTDFTLTISSLQAEDVAVYYCHQYYSSYTFGQGTKLEIK

SEQ ID NO: 1198 - DNA, 354 bp, Artificial Sequence
  Description of Artificial Sequence: Synthetic Variable heavy chain
caggtgcagctggtgcagagcggagccgaggtgaagaagcctggagcttccgtcaaggtgtcctgcaaggccagcggctacaccttcgccagcgcgtggatgcactggatgcggcaggcacctggacagggcctcgaatggatcggctggatcaaccccggcaacgtgaacaccaagtacaacgagaagttcaagggcagggccaccctgaccgtggacaccagcaccaacaccgcctacatggaactgagcagcctgcggagcgaggacaccgccgtgtactactgcgccagaagcacgtattaccggccgctggactactggggccagggcaccctggtgaccgtgagcagc

SEQ ID NO: 1199 - protein, 118 aa, Artificial Sequence
  Description of Artificial Sequence: Synthetic Variable heavy chain
QVQLVQSGAEVKKPGASVKVSCKASGYTFASAWMHWMRQAPGQGLEWIGWINPGNVNTKYNEKFKGRATLTVDTSTNTAYMELSSLRSEDTAVYYCARSTYYRPLDYWGQGTLVTVSS

SEQ ID NO: 1200 - DNA, 336 bp, Artificial Sequence
  Description of Artificial Sequence: Synthetic Variable light chain
gacatcgtgatgacccagagccccgacagcctggccgtgagcctgggcgagcgggccaccatcaactgcaagagcagccagagcatcctgtacagcagcaaccagaagaactacctggcctggtatcagcagaagcccggccagagccccaagctgctgatctactgggccagcacccgggagagcggcgtgcccgaccggtttagcggcagcggctccggcaccgacttcaccctgaccatcagcagcctgcaggccgaggacgtggccgtgtactactgccaccagtacatgagcagctacaccttcggccagggcacaaagctggaaatcaag

SEQ ID NO: 1201 - protein, 112 aa, Artificial Sequence
  Description of Artificial Sequence: Synthetic Variable light chain
DIVMTQSPDSLAVSLGERATINCKSSQSILYSSNQKNYLAWYQQKPGQSPKLLIYWASTRESGVPDRFSGSGSGTDFTLTISSLQAEDVAVYYCHQYMSSYTFGQGTKLEIK

SEQ ID NO: 1202 - protein, 8 aa, Artificial Sequence
  Description of Artificial Sequence: Synthetic Variable heavy chain, CDR1
GYTFASYY

SEQ ID NO: 1203 - protein, 8 aa, Artificial Sequence
  Description of Artificial Sequence: Synthetic Variable heavy chain, CDR1
GYTFASQW

SEQ ID NO: 1204 - protein, 8 aa, Artificial Sequence
  Description of Artificial Sequence: Synthetic Variable heavy chain, CDR1
GYTFASSW

SEQ ID NO: 1205 - protein, 8 aa, Artificial Sequence
  Description of Artificial Sequence: Synthetic Variable heavy chain, CDR1
GYTFASQY

SEQ ID NO: 1206 - protein, 8 aa, Artificial Sequence
  Description of Artificial Sequence: Synthetic Variable heavy chain, CDR1
GYTFASAW

SEQ ID NO: 1207 - protein, 12 aa, Artificial Sequence
  Description of Artificial Sequence: Synthetic Variable light chain, CDR1
QSILYSSNQKNY

SEQ ID NO: 1208 - protein, 8 aa, Artificial Sequence
  Description of Artificial Sequence: Synthetic Variable heavy chain, CDR2
INPGNVNT

SEQ ID NO: 1209 - protein, 6 aa, Artificial Sequence
  Description of Artificial Sequence: Synthetic Variable light chain, CDR2
WASTRE

SEQ ID NO: 1210 - protein, 9 aa, Artificial Sequence
  Description of Artificial Sequence: Synthetic Variable heavy chain, CDR3
STYYRPLDY

SEQ ID NO: 1211 - protein, 9 aa, Artificial Sequence
  Description of Artificial Sequence: Synthetic Variable heavy chain, CDR3
STWYRPLDY

SEQ ID NO: 1212 - protein, 9 aa, Artificial Sequence
  Description of Artificial Sequence: Synthetic Variable heavy chain, CDR3
STWYRPNDY

SEQ ID NO: 1213 - protein, 9 aa, Artificial Sequence
  Description of Artificial Sequence: Synthetic Variable heavy chain, CDR3
TTRYRPLDY

SEQ ID NO: 1214 - protein, 9 aa, Artificial Sequence
  Description of Artificial Sequence: Synthetic Variable heavy chain, CDR3
LTYYRPPDY

SEQ ID NO: 1215 - protein, 8 aa, Artificial Sequence
  Description of Artificial Sequence: Synthetic Variable light chain, CDR3
HQYLSSYT

SEQ ID NO: 1216 - protein, 8 aa, Artificial Sequence
  Description of Artificial Sequence: Synthetic Variable light chain, CDR3
HQYISSYT

SEQ ID NO: 1217 - protein, 8 aa, Artificial Sequence
  Description of Artificial Sequence: Synthetic Variable light chain, CDR3
HQYKSSYT

SEQ ID NO: 1218 - protein, 8 aa, Artificial Sequence
  Description of Artificial Sequence: Synthetic Variable light chain, CDR3
HQYRSSYT

SEQ ID NO: 1219 - protein, 8 aa, Artificial Sequence
  Description of Artificial Sequence: Synthetic Variable light chain, CDR3
HQYYSSYT

SEQ ID NO: 1220 - protein, 8 aa, Artificial Sequence
  Description of Artificial Sequence: Synthetic Variable light chain, CDR3
HQYMSSYT

SEQ ID NO: 1221 - DNA, 27 bp, Artificial Sequence
  Description of Artificial Sequence: Synthetic Chemically synthesized primer
tctgagtaggtgtcattctattctggg

SEQ ID NO: 1222 - DNA, 25 bp, Artificial Sequence
  Description of Artificial Sequence: Synthetic Chemically synthesized primer
cactaggggttcctagatctctccc

SEQ ID NO: 1223 - DNA, 26 bp, Artificial Sequence
  Description of Artificial Sequence: Synthetic Chemically synthesized probe
tcttcccaatcctcccccttgctgtc

SEQ ID NO: 1224 - protein, 123 aa, Artificial Sequence
  Description of Artificial Sequence: Synthetic polypeptide
TRVLSQVQLVQSGAEVKKPGASVKVSCKASGYTFSGYSTHWLRQVPGQGLEWIGWDNPSSGDTTYAENFRGRVTLTRDTSITTDYLEVRGLRSDDTAVYYCARGGDDYSFDHWGQGTLVTVSS

SEQ ID NO: 1225 - DNA, 354 bp, Artificial Sequence
  Description of Artificial Sequence: Synthetic polynucleotide
  modified_base (62)..(62): a, c, t, or g
  modified_base (90)..(90): a, c, t, or g
  modified_base (120)..(120): a, c, t, or g
  modified_base (182)..(182): a, c, t, or g
  modified_base (190)..(192): a, c, t, or g
  modified_base (208)..(208): a, c, t, or g
  modified_base (256)..(256): a, c, t, or g
  modified_base (279)..(279): a, c, t, or g
  modified_base (288)..(288): a, c, t, or g
  modified_base (297)..(297): a, c, t, or g
caggtgcagctggtgcagtctggggctgaggtgaagaagcctggggcctcagtgaaagtctnctgcaaggcttctggatacaccttcagnggctactctacacactggctgcgacaggtncctggacagggacttgagtggattggatgggacaaccctagtagtggtgacacgacctatgnagagaatnnncggggcagggtcaccntgaccagggacacgtccatcaccacagattacttggaagtgaggggtntaagatctgacgacacggccgtntattattgngccagaggnggagatgactacagctttgaccattggggtcagggcaccctggtcaccgtctcctca

SEQ ID NO: 1226 - protein, 105 aa, Artificial Sequence
  Description of Artificial Sequence: Synthetic polypeptide
SSELTQDPAVSVALGQTVRITCRGDSLRSYYASWYQQKPGQAPVLVIYGENNRPSGIPDRFSGSSSGDTASLTITGAQAEDEADYYCNSRDSSDHLLLFGQGTKL

SEQ ID NO: 1227 - DNA, 327 bp, Artificial Sequence
  Description of Artificial Sequence: Synthetic polynucleotide
tcttctgagctgactcaggacccagctgtgtctgtggccttgggacagacagtcaggatcacatgccgaggagacagcctcagaagttattatgcaagctggtaccaacagaagccaggacaggcccctgtacttgtcatctatggtgaaaacaaccgaccctcagggatcccagaccgattctctggctccagctcaggagacacagcttccttgaccatcactggggctcaggcggaagatgaggctgactattactgtaactcccgggacagcagtgatcaccttctcctattcggtggagggaccaagttgaccgtcctaggt

SEQ ID NO: 1228 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1229 - DNA, 992 bp, Homo sapiens
ctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagcagagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 1230 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1231 - DNA, 992 bp, Artificial Sequence
  Description of Artificial Sequence: Synthetic polynucleotide
ctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagcagagcccaaatcttgtgacaaaactcacacatgcccaccgtgcccagcacctgaagccgccgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 1232 - protein, 97 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKK

SEQ ID NO: 1233 - DNA, 290 bp, Homo sapiens
ctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaa

SEQ ID NO: 1234 - protein, 110 aa, Homo sapiens
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 1235 - DNA, 330 bp, Homo sapiens
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaa

SEQ ID NO: 1236 - protein, 110 aa, Artificial Sequence
  Description of Artificial Sequence: Synthetic polypeptide
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 1237 - DNA, 330 bp, Artificial Sequence
  Description of Artificial Sequence: Synthetic polynucleotide
gcacctgaagccgccgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaa

SEQ ID NO: 1238 - protein, 107 aa, Homo sapiens
GQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1239 - DNA, 324 bp, Homo sapiens
gggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 1240 - protein, 16 aa, Homo sapiens
AEPKSCDKTHTCPPCP

SEQ ID NO: 1241 - DNA, 48 bp, Homo sapiens
gcagagcccaaatcttgtgacaaaactcacacatgcccaccgtgccca

SEQ ID NO: 1242 - protein, 453 aa, Homo sapiens
TRVLSQVQLVQSGAEVKKPGASVKVSCKASGYTFSGYSTHWLRQVPGQGLEWIGWDNPSSGDTTYAENFRGRVTLTRDTSITTDYLEVRGLRSDDTAVYYCARGGDDYSFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1243 - protein, 453 aa, Artificial Sequence
  Description of Artificial Sequence: Synthetic polypeptide
TRVLSQVQLVQSGAEVKKPGASVKVSCKASGYTFSGYSTHWLRQVPGQGLEWIGWDNPSSGDTTYAENFRGRVTLTRDTSITTDYLEVRGLRSDDTAVYYCARGGDDYSFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1244 - protein, 5 aa, Artificial Sequence
  Description of Artificial Sequence: Synthetic peptide
GYSTH

SEQ ID NO: 1245 - protein, 17 aa, Artificial Sequence
  Description of Artificial Sequence: Synthetic peptide
WDNPSSGDTTYAENFRG

SEQ ID NO: 1246 - protein, 9 aa, Artificial Sequence
  Description of Artificial Sequence: Synthetic peptide
GGDDYSFDH

SEQ ID NO: 1247 - protein, 11 aa, Artificial Sequence
  Description of Artificial Sequence: Synthetic peptide
RGDSLRSYYAS

SEQ ID NO: 1248 - protein, 7 aa, Artificial Sequence
  Description of Artificial Sequence: Synthetic peptide
GENNRPS

SEQ ID NO: 1249 - protein, 11 aa, Artificial Sequence
  Description of Artificial Sequence: Synthetic peptide
NSRDSSDHLLL

SEQ ID NO: 1250 - protein, 121 aa, Homo sapiens; identical to SEQ ID NO: 845

SEQ ID NO: 1251 - protein, 113 aa, Homo sapiens; identical to SEQ ID NO: 846

SEQ ID NO: 1252 - protein, 119 aa, Homo sapiens; identical to SEQ ID NO: 847

SEQ ID NO: 1253 - protein, 119 aa, Homo sapiens; identical to SEQ ID NO: 848

SEQ ID NO: 1254 - protein, 119 aa, Homo sapiens; identical to SEQ ID NO: 848

SEQ ID NO: 1255 - protein, 119 aa, Homo sapiens; identical to SEQ ID NO: 850

SEQ ID NO: 1256 - protein, 119 aa, Homo sapiens; identical to SEQ ID NO: 851

SEQ ID NO: 1257 - protein, 118 aa, Homo sapiens; identical to SEQ ID NO: 852

SEQ ID NO: 1258 - protein, 119 aa, Homo sapiens; identical to SEQ ID NO: 853

SEQ ID NO: 1259 - protein, 119 aa, Homo sapiens; identical to SEQ ID NO: 848

SEQ ID NO: 1260 - protein, 119 aa, Homo sapiens; identical to SEQ ID NO: 855

SEQ ID NO: 1261 - protein, 116 aa, Homo sapiens; identical to SEQ ID NO: 856

SEQ ID NO: 1262 - protein, 119 aa, Homo sapiens; identical to SEQ ID NO: 857

SEQ ID NO: 1263 - protein, 122 aa, Homo sapiens; identical to SEQ ID NO: 858

SEQ ID NO: 1264 - protein, 118 aa, Homo sapiens; identical to SEQ ID NO: 859

SEQ ID NO: 1265 - protein, 118 aa, Homo sapiens; identical to SEQ ID NO: 859

SEQ ID NO: 1266 - protein, 116 aa, Homo sapiens; identical to SEQ ID NO: 861

SEQ ID NO: 1267 - protein, 118 aa, Homo sapiens; identical to SEQ ID NO: 862

SEQ ID NO: 1268 - protein, 122 aa, Homo sapiens; identical to SEQ ID NO: 863

SEQ ID NO: 1269 - protein, 119 aa, Homo sapiens; identical to SEQ ID NO: 864

SEQ ID NO: 1270 - protein, 119 aa, Homo sapiens; identical to SEQ ID NO: 851

SEQ ID NO: 1271 - protein, 121 aa, Homo sapiens; identical to SEQ ID NO: 866

SEQ ID NO: 1272 - protein, 118 aa, Homo sapiens; identical to SEQ ID NO: 867

SEQ ID NO: 1273 - protein, 112 aa, Homo sapiens; identical to SEQ ID NO: 868

SEQ ID NO: 1274 - protein, 111 aa, Homo sapiens; identical to SEQ ID NO: 869

SEQ ID NO: 1275 - protein, 112 aa, Homo sapiens; identical to SEQ ID NO: 870

SEQ ID NO: 1276 - protein, 112 aa, Homo sapiens; identical to SEQ ID NO: 871

SEQ ID NO: 1277 - protein, 112 aa, Homo sapiens; identical to SEQ ID NO: 872

SEQ ID NO: 1278 - protein, 111 aa, Homo sapiens; identical to SEQ ID NO: 873

SEQ ID NO: 1279 - protein, 111 aa, Homo sapiens; identical to SEQ ID NO: 874

SEQ ID NO: 1280 - protein, 111 aa, Homo sapiens; identical to SEQ ID NO: 875

SEQ ID NO: 1281 - protein, 112 aa, Homo sapiens; identical to SEQ ID NO: 876

SEQ ID NO: 1282 - protein, 112 aa, Homo sapiens; identical to SEQ ID NO: 877

SEQ ID NO: 1283 - protein, 111 aa, Homo sapiens; identical to SEQ ID NO: 878

SEQ ID NO: 1284 - protein, 111 aa, Homo sapiens; identical to SEQ ID NO: 879

SEQ ID NO: 1285 - protein, 112 aa, Homo sapiens; identical to SEQ ID NO: 880

SEQ ID NO: 1286 - protein, 112 aa, Homo sapiens; identical to SEQ ID NO: 881
  MOD_RES (83)..(83): Any naturally occurring amino acid

SEQ ID NO: 1287 - protein, 110 aa, Homo sapiens; identical to SEQ ID NO: 882

SEQ ID NO: 1288 - protein, 112 aa, Homo sapiens; identical to SEQ ID NO: 883

SEQ ID NO: 1289 - protein, 112 aa, Homo sapiens; identical to SEQ ID NO: 883

SEQ ID NO: 1290 - protein, 111 aa, Homo sapiens; identical to SEQ ID NO: 885

SEQ ID NO: 1291 - protein, 112 aa, Homo sapiens; identical to SEQ ID NO: 886

SEQ ID NO: 1292 - protein, 109 aa, Homo sapiens; identical to SEQ ID NO: 887

SEQ ID NO: 1293 - protein, 109 aa, Homo sapiens; identical to SEQ ID NO: 888

SEQ ID NO: 1294 - protein, 458 aa, Homo sapiens; identical to SEQ ID NO: 889

SEQ ID NO: 1295 - protein, 437 aa, Mus musculus; identical to SEQ ID NO: 890

SEQ ID NO: 1296 - DNA, 38 bp, Artificial Sequence; identical to SEQ ID NO: 891
  Description of Artificial Sequence: Synthetic Chemically synthesized primer

SEQ ID NO: 1297 - DNA, 32 bp, Artificial Sequence; identical to SEQ ID NO: 892
  Description of Artificial Sequence: Synthetic Chemically synthesized primer

SEQ ID NO: 1298 - DNA, 35 bp, Artificial Sequence; identical to SEQ ID NO: 893
  Description of Artificial Sequence: Synthetic Chemically synthesized primer

SEQ ID NO: 1299 - DNA, 31 bp, Artificial Sequence; identical to SEQ ID NO: 894
  Description of Artificial Sequence: Synthetic Chemically synthesized primer

SEQ ID NO: 1300 - DNA, 41 bp, Artificial Sequence; identical to SEQ ID NO: 895
  Description of Artificial Sequence: Synthetic Chemically synthesized primer

SEQ ID NO: 1301 - DNA, 32 bp, Artificial Sequence; identical to SEQ ID NO: 896
  Description of Artificial Sequence: Synthetic Chemically synthesized primer

SEQ ID NO: 1302 - DNA, 35 bp, Artificial Sequence; identical to SEQ ID NO: 897
  Description of Artificial Sequence: Synthetic Chemically synthesized primer

SEQ ID NO: 1303 - DNA, 26 bp, Artificial Sequence
  Description of Artificial Sequence: Synthetic Chemically synthesized primer
atagcacctaggacggtcagcttggt

SEQ ID NO: 1304 - protein, 5 aa, Artificial Sequence
  Description of Artificial Sequence: Synthetic Portion of CDR1 heavy chain sequence
SYAMS

SEQ ID NO: 1305 - protein, 5 aa, Artificial Sequence
  Description of Artificial Sequence: Synthetic Portion of CDR1 heavy chain sequence
  MOD_RES (1)..(1): Any naturally occurring amino acid
  MOD_RES (5)..(5): Any naturally occurring amino acid
XYAMX

SEQ ID NO: 1306 - protein, 5 aa, Artificial Sequence
  Description of Artificial Sequence: Synthetic Portion of CDR1 heavy chain sequence
  MOD_RES (3)..(3): Any naturally occurring amino acid
  MOD_RES (5)..(5): Any naturally occurring amino acid
SYXMX

SEQ ID NO: 1307 - protein, 17 aa, Artificial Sequence
  Description of Artificial Sequence: Synthetic Portion of CDR2 heavy chain sequence
  MOD_RES (4)..(5): Any naturally occurring amino acid
  MOD_RES (8)..(8): Any naturally occurring amino acid
  MOD_RES (10)..(11): Any naturally occurring amino acid
AISXXGGXTXXADSVKG

SEQ ID NO: 1308 - protein, 17 aa, Artificial Sequence
  Description of Artificial Sequence: Synthetic Portion of CDR2 heavy chain sequence
AISGSGGSTTTADSVKG

SEQ ID NO: 1309 - protein, 13 aa, Artificial Sequence
  Description of Artificial Sequence: Synthetic Portion of CDR3 heavy chain sequence
  MOD_RES (9)..(9): Any naturally occurring amino acid
NGNYRGSLXAFDI

SEQ ID NO: 1310 - protein, 14 aa, Artificial Sequence
  Description of Artificial Sequence: Synthetic Portion of CDR1 light chain sequence
TGSSSNIGAGYDVH

SEQ ID NO: 1311 - protein, 7 aa, Artificial Sequence
  Description of Artificial Sequence: Synthetic Portion of CDR2 light chain sequence
GNNNRPS

SEQ ID NO: 1312 - protein, 12 aa, Artificial Sequence
  Description of Artificial Sequence: Synthetic Portion of CDR3 light chain sequence
QSYDSSLSAWVV

SEQ ID NO: 1313 - protein, 6 aa, Artificial Sequence
  Description of Artificial Sequence: Synthetic Consensus sequence
EEDLPE

SEQ ID NO: 1314 - protein, 10 aa, Artificial Sequence
  Description of Artificial Sequence: Synthetic Portion of the CDR3 heavy chain sequence
NGNYRGAFDI

SEQ ID NO: 1315 - DNA, 354 bp, Artificial Sequence
  Description of Artificial Sequence: Synthetic polynucleotide
caggtgcagctggtgcagagcggcgcggaagtgaaaaaaccgggcgcgagcgtgaaagtgagctgcaaagcgagcggctatacctttgcgagcgcgtggatgcattggatgcgccaggcgccgggccagggcctggaatggattggctggattaacccgggcaacgtgaacaccaaatataacgaaaaatttaaaggccgcgcgaccctgaccgtggataccagcaccaacaccgcgtatatggaactgagcagcctgcgcagcgaagataccgcggtgtattattgcgcgcgcagcacctattatcgcccgctggattattggggccagggcaccctggtgaccgtgagcagc

SEQ ID NO: 1316 - protein, 118 aa, Artificial Sequence; identical to SEQ ID NO: 1199
  Description of Artificial Sequence: Synthetic polypeptide

SEQ ID NO: 1317 - DNA, 336 bp, Artificial Sequence
  Description of Artificial Sequence: Synthetic polynucleotide
gatattgtgatgacccagagcccggatagcctggcggtgagcctgggcgaacgcgcgaccattaactgcaaaagcagccagagcattctgtatagcagcaaccagaaaaactatctggcgtggtatcagcagaaaccgggccagagcccgaaactgctgatttattgggcgagcacccgcgaaagcggcgtgccggatcgctttagcggcagcggcagcggcaccgattttaccctgaccattagcagcctgcaggcggaagatgtggcggtgtattattgccatcagtatatgagcagctatacctttggccagggcaccaaactggaaattaaa

SEQ ID NO: 1318 - protein, 112 aa, Artificial Sequence; identical to SEQ ID NO: 1201
  Description of Artificial Sequence: Synthetic polypeptide

SEQ ID NO: 1319 - DNA, 981 bp, Artificial Sequence
  Description of Artificial Sequence: Synthetic polynucleotide
gcgagcaccaaaggcccgagcgtgtttccgctggcgccgtgcagccgcagcaccagcgaaagcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcaccaaaacctatacctgcaacgtggatcataaaccgagcaacaccaaagtggataaacgcgtggaaagcaaatatggcccgccgtgcccgagctgcccggcgccggaatttctgggcggcccgagcgtgtttctgtttccgccgaaaccgaaagataccctgatgattagccgcaccccggaagtgacctgcgtggtggtggatgtgagccaggaagatccggaagtgcagtttaactggtatgtggatggcgtggaagtgcataacgcgaaaaccaaaccgcgcgaagaacagtttaacagcacctatcgcgtggtgagcgtgctgaccgtgctgcatcaggattggctgaacggcaaagaatataaatgcaaagtgagcaacaaaggcctgccgagcagcattgaaaaaaccattagcaaagcgaaaggccagccgcgcgaaccgcaggtgtataccctgccgccgagcccggaagaaatgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagccgcctgaccgtggataaaagccgctggcaggaaggcaacgtgtttagctgcagcgtgatgcatgaagcgctgcataaccattatacccagaaaagcctgagcctgagcctgggcaaa

SEQ ID NO: 1320 - protein, 327 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSPEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1321 - DNA, 975 bp, Artificial Sequence
  Description of Artificial Sequence: Synthetic polynucleotide
accaaaggcccgagcgtgtttccgctggcgccgtgcagccgcagcaccagcgaaagcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcaccaaaacctatacctgcaacgtggatcataaaccgagcaacaccaaagtggataaacgcgtggaaagcaaatatggcccgccgtgcccgccgtgcccggcgccggaatttctgggcggcccgagcgtgtttctgtttccgccgaaaccgaaagataccctgatgattagccgcaccccggaagtgacctgcgtggtggtggatgtgagccaggaagatccggaagtgcagtttaactggtatgtggatggcgtggaagtgcataacgcgaaaaccaaaccgcgcgaagaacagtttaacagcacctatcgcgtggtgagcgtgctgaccgtgctgcatcaggattggctgaacggcaaagaatataaatgcaaagtgagcaacaaaggcctgccgagcagcattgaaaaaaccattagcaaagcgaaaggccagccgcgcgaaccgcaggtgtataccctgccgccgagcccggaagaaatgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcaggaaggcaacgtgtttagctgcagcgtgatgcatgaagcgctgcataaccattatacccagaaaagcctgagcctgagcctgggcaaa

SEQ ID NO: 1322 - protein, 325 aa, Artificial Sequence
  Description of Artificial Sequence: Synthetic polypeptide
TKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSPEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 1323 - protein, 8 aa, Artificial Sequence
  Description of Artificial Sequence: Synthetic peptide
GYTFASAW

SEQ ID NO: 1324 - protein, 12 aa, Artificial Sequence
  Description of Artificial Sequence: Synthetic peptide
QSILYSSNQKNY

SEQ ID NO: 1325 - protein, 8 aa, Artificial Sequence
  Description of Artificial Sequence: Synthetic peptide
INPGNVNT

SEQ ID NO: 1326 - protein, 6 aa, Artificial Sequence
  Description of Artificial Sequence: Synthetic peptide
WASTRE

SEQ ID NO: 1327 - protein, 9 aa, Artificial Sequence
  Description of Artificial Sequence: Synthetic peptide
STYYRPLDY

SEQ ID NO: 1328 - protein, 8 aa, Artificial Sequence
  Description of Artificial Sequence: Synthetic peptide
HQYMSSYT

SEQ ID NO: 1329 - DNA, 354 bp, Artificial Sequence; identical to SEQ ID NO: 1182
  Description of Artificial Sequence: Synthetic polynucleotide

SEQ ID NO: 1330 - protein, 118 aa, Artificial Sequence; identical to SEQ ID NO: 1183
  Description of Artificial Sequence: Synthetic polypeptide

SEQ ID NO: 1331 - DNA, 336 bp, Artificial Sequence; identical to SEQ ID NO: 1184
  Description of Artificial Sequence: Synthetic polynucleotide

SEQ ID NO: 1332 - protein, 112 aa, Artificial Sequence; identical to SEQ ID NO: 1185
  Description of Artificial Sequence: Synthetic polypeptide

SEQ ID NO: 1333 - DNA, 354 bp, Artificial Sequence; identical to SEQ ID NO: 1186
  Description of Artificial Sequence: Synthetic polynucleotide

SEQ ID NO: 1334 - protein, 118 aa, Artificial Sequence; identical to SEQ ID NO: 1187
  Description of Artificial Sequence: Synthetic polypeptide

SEQ ID NO: 1335 - DNA, 336 bp, Artificial Sequence; identical to SEQ ID NO: 1188
  Description of Artificial Sequence: Synthetic polynucleotide

SEQ ID NO: 1336 - protein, 112 aa, Artificial Sequence; identical to SEQ ID NO: 1189
  Description of Artificial Sequence: Synthetic polypeptide

SEQ ID NO: 1337 - DNA, 354 bp, Artificial Sequence; identical to SEQ ID NO: 1190
  Description of Artificial Sequence: Synthetic polynucleotide

SEQ ID NO: 1338 - protein, 118 aa, Artificial Sequence; identical to SEQ ID NO: 1191
  Description of Artificial Sequence: Synthetic polypeptide

SEQ ID NO: 1339 - DNA, 336 bp, Artificial Sequence; identical to SEQ ID NO: 1192
  Description of Artificial Sequence: Synthetic polynucleotide

SEQ ID NO: 1340 - protein, 112 aa, Artificial Sequence; identical to SEQ ID NO: 1193
  Description of Artificial Sequence: Synthetic polypeptide

SEQ ID NO: 1341 - DNA, 354 bp, Artificial Sequence; identical to SEQ ID NO: 1194
  Description of Artificial Sequence: Synthetic polynucleotide

SEQ ID NO: 1342 - protein, 118 aa, Artificial Sequence; identical to SEQ ID NO: 1195
  Description of Artificial Sequence: Synthetic polypeptide

SEQ ID NO: 1343 - DNA, 336 bp, Artificial Sequence; identical to SEQ ID NO: 1196
  Description of Artificial Sequence: Synthetic polynucleotide

SEQ ID NO: 1344 - protein, 112 aa, Artificial Sequence; identical to SEQ ID NO: 1197
  Description of Artificial Sequence: Synthetic polypeptide

SEQ ID NO: 1345 - protein, 8 aa, Artificial Sequence
  Description of Artificial Sequence: Synthetic peptide
GYTFASYY

SEQ ID NO: 1346 - protein, 8 aa, Artificial Sequence
  Description of Artificial Sequence: Synthetic peptide
GYTFASYY

SEQ ID NO: 1347 - protein, 8 aa, Artificial Sequence
  Description of Artificial Sequence: Synthetic peptide
GYTFASSW

SEQ ID NO: 1348 - protein, 9 aa, Artificial Sequence
  Description of Artificial Sequence: Synthetic peptide
STWYRPLDY

SEQ ID NO: 1349 - protein, 9 aa, Artificial Sequence
  Description of Artificial Sequence: Synthetic peptide
STWYRPNDY

SEQ ID NO: 1350 - protein, 9 aa, Artificial Sequence
  Description of Artificial Sequence: Synthetic peptide
TTRYRPLDY

SEQ ID NO: 1351 - protein, 9 aa, Artificial Sequence
  Description of Artificial Sequence: Synthetic peptide
LTYYRPPDY

SEQ ID NO: 1352 - protein, 8 aa, Artificial Sequence
  Description of Artificial Sequence: Synthetic peptide
HQYLSSYT

SEQ ID NO: 1353 - protein, 8 aa, Artificial Sequence
  Description of Artificial Sequence: Synthetic peptide
HQYISSYT

SEQ ID NO: 1354 - protein, 8 aa, Artificial Sequence
  Description of Artificial Sequence: Synthetic peptide
HQYKSSYT

SEQ ID NO: 1355 - protein, 8 aa, Artificial Sequence
  Description of Artificial Sequence: Synthetic peptide
HQYRSSYT

SEQ ID NO: 1356 - protein, 8 aa, Artificial Sequence
  Description of Artificial Sequence: Synthetic peptide
HQYYSSYT

SEQ ID NO: 1357 - DNA, 354 bp, Artificial Sequence; identical to SEQ ID NO: 966
  Description of Artificial Sequence: Synthetic polynucleotide

SEQ ID NO: 1358 - protein, 118 aa, Artificial Sequence; identical to SEQ ID NO: 967
  Description of Artificial Sequence: Synthetic polypeptide

SEQ ID NO: 1359 - DNA, 336 bp, Artificial Sequence; identical to SEQ ID NO: 968
  Description of Artificial Sequence: Synthetic polynucleotide

SEQ ID NO: 1360 - protein, 112 aa, Artificial Sequence; identical to SEQ ID NO: 969
  Description of Artificial Sequence: Synthetic polypeptide

SEQ ID NO: 1361 - DNA, 360 bp, Artificial Sequence
  Description of Artificial Sequence: Synthetic polynucleotide
gaggtgcagctggtggagtctggggctgaggtgaagaagcctggggcctcagtgaaggtctcctgcaagacttctggatacaccttcaccgaccactatatccactgggtgcgacaggcccctggacaagggcttgagtggatgggatggatcaaccctagcagtggtggcacagagtatgcacagaagtttcagggcagggtcaccatgaccagggacacgcccattagcacggcctacatggatctgagcgggctgagatctgacgacacggccgtttattactgtgcgagagagactatcggtggctggaacgctttggacgtctggggccaaggaaccctggtcaccgtctcctca

SEQ ID NO: 1362 - protein, 120 aa, Artificial Sequence
  Description of Artificial Sequence: Synthetic polypeptide
EVQLVESGAEVKKPGASVKVSCKTSGYTFTDHYIHWVRQAPGQGLEWMGWINPSSGGTEYAQKFQGRVTMTRDTPISTAYMDLSGLRSDDTAVYYCARETIGGWNALDVWGQGTLVTVSS

SEQ ID NO: 1363 - DNA, 333 bp, Artificial Sequence
  Description of Artificial Sequence: Synthetic polynucleotide
cagcctgtgctgactcagccaccctcagcgtctgggacccccgggcagagggtcaccatctcttgttctggaagcagctccaacatcggaattaatactgtaaactggtaccagcagctcccaagaacgccccccaaactcctcatctatactaataatcagcggccctcaggggtccctgaccgattctctggctccaagtctgacacctcagcctccctggccatcagtggcctccagtctgaggatgaggctgattattactgtgcagcttgggatgacaccctgaatggtccactattcggcggagggaccaaggtgaccgtcctaggt

SEQ ID NO: 1364 - protein, 111 aa, Artificial Sequence
  Description of Artificial Sequence: Synthetic polypeptide
QPVLTQPPSASGTPGQRVTISCSGSSSNIGINTVNWYQQLPRTPPKLLIYTNNQRPSGVPDRFSGSKSDTSASLAISGLQSEDEADYYCAAWDDTLNGPLFGGGTKVTVLG

SEQ ID NO: 1365 - DNA, 357 bp, Artificial Sequence
  Description of Artificial Sequence: Synthetic polynucleotide
gaggtgcagctggtgcagtctgggtctgagttgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccgtgaccacagacacgtccacgagcacagcctacatggagctgaggagcctgagatctgacgacacggccgtctattactgtgcgagagagggtgttcactcggatgcttttgatgtgtggggccaagggaccacggtcaccgtctcctca

SEQ ID NO: 1366 - protein, 119 aa, Artificial Sequence
  Description of Artificial Sequence: Synthetic polypeptide
EVQLVQSGSELKKPGASVKVSCKASGYTFTGYYMHWVRQAPGQGLEWMGWINPNSGGTNYAQKFQGRVTVTTDTSTSTAYMELRSLRSDDTAVYYCAREGVHSDAFDVWGQGTTVTVSS

SEQ ID NO: 1367 - DNA, 321 bp, Artificial Sequence
  Description of Artificial Sequence: Synthetic polynucleotide
gaaacgacactcacgcagtctccagccaccctgtctgtgtctccaggggaaagggccaccctctcctgcagggccagtcagagtgtttacaccaacttagcctggtaccaacagaaacctggccaggctcccagtctcctcatctatggtgcatccagccgggccaccggcatcccagacagattcagtggcagcgggtctgggacagacttcactctcaccatcagcagactggagcctgaagattttgcagtgtattactgtcagcagtatggtagctcacatttcactttcggccctgggaccaaagtggatatcaaa

SEQ ID NO: 1368 - protein, 107 aa, Artificial Sequence
  Description of Artificial Sequence: Synthetic polypeptide
ETTLTQSPATLSVSPGERATLSCRASQSVYTNLAWYQQKPGQAPSLLIYGASSRATGIPDRFSGSGSGTDFTLTISRLEPEDFAVYYCQQYGSSHFTFGPGTKVDIK

SEQ ID NO: 1369 - DNA, 360 bp, Artificial Sequence
  Description of Artificial Sequence: Synthetic polynucleotide
gaggtgcagctggtgcagtctggggctgaggtgaagaagcctggggcctcagtgaaggtctcctgcaagacttctggatacaccttcaccgaccactatatccactgggtgcgacaggcccctggacaagggcttgagtggatgggatggatcaaccctagcagtggtggcacagagtatgcacagaagtttcagggcagggtcaccatgaccagggacacgcccattagcacggcctacatggatctgagcgggctgagatctgacgacacggccgtttattactgtgcgagagagactatcggtggctggaacgctttggacgtctggggccaagggaccacggtcaccgtctcctca

SEQ ID NO: 1370 - protein, 120 aa, Artificial Sequence
  Description of Artificial Sequence: Synthetic polypeptide
EVQLVQSGAEVKKPGASVKVSCKTSGYTFTDHYIHWVRQAPGQGLEWMGWINPSSGGTEYAQKFQGRVTMTRDTPISTAYMDLSGLRSDDTAVYYCARETIGGWNALDVWGQGTTVTVSS

SEQ ID NO: 1371 - DNA, 333 bp, Artificial Sequence
  Description of Artificial Sequence: Synthetic polynucleotide
cagtctgtgctgactcagccaccctcagcgtctgggtcccccgggcagagggtcaccatgtcttgctctggaagcagctccaccatcgggaggcattctgtaaactggtaccagcagctcccaggaacggcccccaaactcctcatctatgctaacaatcagcggccctcaggggtccctggccgattctctgcctccaagtctgacacctcagcctccctggccatcagtgggctccggtccgaggatgaggctaattattactgtgcagcgtgggatgacagtctcagtggcgtgctctttggcggtgggaccaaggtgaccgtcctaggt

SEQ ID NO: 1372 - protein, 111 aa, Artificial Sequence
  Description of Artificial Sequence: Synthetic polypeptide
QSVLTQPPSASGSPGQRVTMSCSGSSSTIGRHSVNWYQQLPGTAPKLLIYANNQRPSGVPGRFSASKSDTSASLAISGLRSEDEANYYCAAWDDSLSGVLFGGGTKVTVLG

SEQ ID NO: 1373 - DNA, 360 bp, Artificial Sequence
  Description of Artificial Sequence: Synthetic polynucleotide
gaggtgcagctggtggagtctggggctgaggtgaagaagcctggggcctcagtgaaggtctcctgcaagacttctggatacaccttcaccgaccactatatccactgggtgcgacaggcccctggacaagggcttgagtggatgggatggatcaaccctagcagtggtggcacagagtatgcacagaagtttcagggcagggtcaccatgaccagggacacgcccattagcacggcctacatggatctgagcgggctgagatctgacgacacggccgtttattactgtgcgagagagactatcggtggctggaacgctttggacgtctggggccaaggcaccctggtcaccgtctcctca

SEQ ID NO: 1374 - protein, 120 aa, Artificial Sequence; identical to SEQ ID NO: 1362
  Description of Artificial Sequence: Synthetic polypeptide

SEQ ID NO: 1375 - DNA, 327 bp, Artificial Sequence
  Description of Artificial Sequence: Synthetic polynucleotide
ctgcctgtgctgactcagccaccctcagtgtcagtggccccaggacagacggccaggataacctgtgggggacacaagattggaactaaaagtgtgcactggtaccagcagaagccaggccaggcccctgtactggtcgtctatgatgatcgcgaccggccctcagggatccctgagcgattctctggctccaactctgggggcacggccaccctgaccatcagcagggtcgaagccggggatgaggccgactattactgtcaggtgtgggatagtaatagtgatcatgtggtgttcggcggagggaccaagctgaccgtcctaagt

SEQ ID NO: 1376 - protein, 109 aa, Artificial Sequence
  Description of Artificial Sequence: Synthetic polypeptide
MPVLTQPPSVSVAPGQTARITCGGHKIGTKSVHWYQQKPGQAPVLVVYDDRDRPSGIPERFSGSNSGGTATLTISRVEAGDEADYYCQVWDSNSDHVVFGGGTKLTVLS

SEQ ID NO: 1377 - DNA, 360 bp, Artificial Sequence
  Description of Artificial Sequence: Synthetic polynucleotide
gaggtgcagctggtgcagtctggggctgatgtgaagaagcctggggcctcagtgaaggtctcctgcaaggcttctggatacaccttcaccggctactatatacactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtctatttttgtgtgagagaggtgaaagattactattattacatggacgtctggggcagagggaccacggtcaccgtctcctca

SEQ ID NO: 1378 - protein, 120 aa, Artificial Sequence
  Description of Artificial Sequence: Synthetic polypeptide
EVQLVQSGADVKKPGASVKVSCKASGYTFTGYYIHWVRQAPGQGLEWMGWINPNSGGTNYAQKFQGRVTMTRDTSISTAYMELSRLRSDDTAVYFCVREVKDYYYYMDVWGRGTTVTVSS

SEQ ID NO: 1379 - DNA, 336 bp, Artificial Sequence
  Description of Artificial Sequence: Synthetic polynucleotide
aattttatgctgactcagccccactctgtgtcggaatctccggggaagacggttaccatctcgtgcacccgcagcagcggcagcattgccagcaactccgtgcagtggtacctgcagcgcccgggcagtgcccccaccactctgatctttgacaataaacaaagaccgtctggggtccctgatcgcttctctggctccatcgacagctcctccaactctgcctccctcagcatctctgggctgacgactgaggacgaggctgactatttctgtcagtcttatgatgacagtgagcaagtggtgttcggcggagggaccaagctgaccgtcctaagt

SEQ ID NO: 1380 - protein, 112 aa, Artificial Sequence
  Description of Artificial Sequence: Synthetic polypeptide
NFMLTQPHSVSESPGKTVTISCTRSSGSIASNSVQWYLQRPGSAPTTLIFDNKQRPSGVPDRFSGSIDSSSNSASLSISGLTTEDEADYFCQSYDDSEQVVFGGGTKLTVLS

SEQ ID NO: 1381 - DNA, 363 bp, Artificial Sequence
  Description of Artificial Sequence: Synthetic polynucleotide
gaggtgcagctggtggagtctggggctgaggtgaagaagcctggggcctcagtgaaggtctcctgcaaggcttctggatacaccttcaccggctactatatgcactgggtgcgacaggcccctggacaagggcttgagtggttggggtgggtcaaccctcacagtggtggcacaaactatgcacagaagtttcagggcagggtcaccatgaccagggacacgtccatcagcacagcctacatggagctgagcagactgagatctgacgacacggccgtatattactgtgcgagagagactgatatctctgctaattatcactttgactactggggccagggcaccctggtcaccgtctcctca

SEQ ID NO: 1382 - protein, 121 aa, Artificial Sequence
  Description of Artificial Sequence: Synthetic polypeptide
EVQLVESGAEVKKPGASVKVSCKASGYTFTGYYMHWVRQAPGQGLEWLGWVNPHSGGTNYAQKFQGRVTMTRDTSISTAYMELSRLRSDDTAVYYCARETDISANYHFDYWGQGTLVTVSS

SEQ ID NO: 1383 - DNA, 336 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgatgttgggagttataacgctgtctcctggtaccaacaccacccaggcaaagcccccaaactcatgatttatgaggtcagtaagcggccctcaggggtttctaatcggttctctggctccaagtctggcaacacggcctccctgacaatctctgggctccgggctgaggacgaggctgattattattgtgcaacatgggatgacagcctgaaaggtccggtgttcggcggagggaccaagctgaccgtcctgggt

SEQ ID NO: 1384 - protein, 113 aa, Artificial Sequence
  Description of Artificial Sequence: Synthetic polypeptide
QSALTQPASVSGSPGQSITISCTGTSSDVGSYNAVSWYQHHPGKAPKLMIYEVSKRPSGVSNRFSGSKSGNTASLTISGLRAEDEADYYCATWDDSLKGPVFGGGTKLTVLGE

SEQ ID NO: 1385 - DNA, 360 bp, Artificial Sequence
  Description of Artificial Sequence: Synthetic polynucleotide
gaggtgcagctggtgcagtctggggctgaggtgaagaagcctggggcctcagtgaaggtctcctgcaaggcttctggatacaccttcaccggctactatatgcactgggtgcgacaggcccctggacaagggcttgaatggatgggatggatcaaccctaaaactggtgacacaaactatgcacagaagtttcagggcagggtcgccttgagcagggacacgtccttcaacacagcctacatggacctgagcagcctcagatctgacgacacggccgtctattactgtgcgagagagggcctgtcgaccagcagtccccttgactactggggccagggaaccctggtcaccgtctcctca

SEQ ID NO: 1386 - protein, 120 aa, Artificial Sequence
  Description of Artificial Sequence: Synthetic polypeptide
EVQLVQSGAEVKKPGASVKVSCKASGYTFTGYYMHWVRQAPGQGLEWMGWINPKTGDTNYAQKFQGRVALSRDTSFNTAYMDLSSLRSDDTAVYYCAREGLSTSSPLDYWGQGTLVTVSS

SEQ ID NO: 1387 - DNA, 327 bp, Artificial Sequence
  Description of Artificial Sequence: Synthetic polynucleotide
cagcctgggctgactcagccaccctcagtgtcagtggccccaggacagtcggccaagattacctgtggagaaaacgaacttgcaacaaatattgtacactggtaccagcagaagccaggccaggcccctgtgctggtcatctatcatgataacgaccggccctcagggatccctgagcgattctctggctccaacgctgggaacacggccaccctgaccatcagcagggtcgaagccggggatgaggccgacttttactgtcagctgtgggatagtgctagtgatcaagtggtcttcggcggagggaccacgttgaccgtcctaggt

SEQ ID NO: 1388 - protein, 109 aa, Artificial Sequence
  Description of Artificial Sequence: Synthetic polypeptide
QPGLTQPPSVSVAPGQSAKITCGENELATNIVHWYQQKPGQAPVLVIYHDNDRPSGIPERFSGSNAGNTATLTISRVEAGDEADFYCQLWDSASDQVVFGGGTTLTVLG

SEQ ID NO: 1389 - DNA, 363 bp, Artificial Sequence
  Description of Artificial Sequence: Synthetic polynucleotide
gaggtgcagctggtgcagtcaggggctgaggtgaagaggcctggggcctcattgaaggtttcctgcaaggcatctggatacaccttcaccagccactatatacactgggtgcgacaggcccccggacaagggcttgagtggatgggatggatcaacactggcaatggtgacacaagatattcacagaggttccagggcagagtcaccgttaccagggacacatccgcgagcacagtctacatggaactgagcagcctgagatctgaagacacggccgtgtattactgtgcgagagagtctagcagcagctggtttgttgcttttgatgtctggggccaagggaccacggtcaccgtctcctca

SEQ ID NO: 1390 - protein, 121 aa, Artificial Sequence
  Description of Artificial Sequence: Synthetic polypeptide
EVQLVQSGAEVKRPGASLKVSCKASGYTFTSHYIHWVRQAPGQGLEWMGWINTGNGDTRYSQRFQGRVTVTRDTSASTVYMELSSLRSEDTAVYYCARESSSSWFVAFDVWGQGTTVTVSS

SEQ ID NO: 1391 - DNA, 327 bp, Artificial Sequence
  Description of Artificial Sequence: Synthetic polynucleotide
cagcctgtgctgactcagccaccctcggtgtcattggccccaggacagacggccaggattacctgttcggaaaagaacattcgaagtaaaagagtgcactggtaccagcagaagccaggccaggcccctgtcctggtcatgtattctgataacggccggcgctcagggatccctgaccgattttctggctccaactctgggaacacggccaccctgaccatcaccagggtcgaagccggtgatgagggcgacttttactgtcaggtgtgggatccgattactgatcaggtggttttcggcggagggaccaagctgaccgtcctaggt

SEQ ID NO: 1392 - protein, 109 aa, Artificial Sequence
  Description of Artificial Sequence: Synthetic polypeptide
QPVLTQPPSVSLAPGQTARITCSEKNIRSKRVHWYQQKPGQAPVLVMYSDNGRRSGIPDRFSGSNSGNTATLTITRVEAGDEGDFYCQVWDPITDQVVFGGGTKLTVLG

SEQ ID NO: 1393 - DNA, 372 bp, Artificial Sequence
  Description of Artificial Sequence: Synthetic polynucleotide
caggtgcagctggtgcagtctggggctgaggtgaagcagcctgggtcctcagtgaaggtctcctgtaaggcttctggatacaccttcaccggctactatatgcactgggtgcgacaggcccctggagaagggcttgagtggctgggatggatcaaccctcacagtggtggcacaaactatgcacagaagttccagggcagagtcacgattaccgcggacaaatccacgagcacagcctacatggagctgagcagcctgagatctgaggacacggctgtgtattactgtgcgagggagattgtggtggtgactgctccggctgctgcggctatggacgtctggggccaaggcaccctggtcaccgtctcctca

SEQ ID NO: 1394 - protein, 124 aa, Artificial Sequence
  Description of Artificial Sequence: Synthetic polypeptide
QVQLVQSGAEVKQPGSSVKVSCKASGYTFTGYYMHWVRQAPGEGLEWLGWINPHSGGTNYAQKFQGRVTITADKSTSTAYMELSSLRSEDTAVYYCAREIVVVTAPAAAAMDVWGQGTLVTVSS

SEQ ID NO: 1395 - DNA, 333 bp, Artificial Sequence
  Description of Artificial Sequence: Synthetic polynucleotide
cagtctgtgctgactcagccaccctccgcgtccgggtctcctggacagtcagtcaccatctcctgcactggaagcagcagtgacgttgctatttatgaccgtgtctcctggtaccagcagcccccaggcacagcccccaaactcattctttatgatgtccatgatcggccctcaggggtccctgatcgcttctctgggtccaagtctggcaacacggcctccctgaccatctctgggctccaggctgaggacgaggctgattattactgcagttcatacacaaccagcggcacttttgtcttcggaagtgggaccaaggtcaccgtcctaggt

SEQ ID NO: 1396 - protein, 111 aa, Artificial Sequence
  Description of Artificial Sequence: Synthetic polypeptide
QSVLTQPPSASGSPGQSVTISCTGSSSDVAIYDRVSWYQQPPGTAPKLILYDVHDRPSGVPDRFSGSKSGNTASLTISGLQAEDEADYYCSSYTTSGTFVFGSGTKVTVLG

SEQ ID NO: 1397 - DNA, 366 bp, Artificial Sequence
  Description of Artificial Sequence: Synthetic polynucleotide
gaggtgcagctggtgcagtctggggctgaggtgaagaagcctggggcctcagtgaacgtctcctgtaaggcttctggatacaccttcaccggctactatatgcactgggtgcgacaggcccctggacaagggcttgagtggatgggatggatcaaccccaacagtggtggcacaaactatgcacagaagtttcagggcagggtcaccgtgaccacagacacgtccaacagcacagcctacatggagctgaacaggctgaaatctgacgacacggccgtgtattattgtgcgagagaggggtccggggaccttgattccttatacatggacgtctggggcaaagggacaatggtcaccgtctcttca

SEQ ID NO: 1398 - DNA, 324 bp, Artificial Sequence
  Description of Artificial Sequence: Synthetic polynucleotide
tcctatgagctgactcagccaccctcggtgtcagtggccccaggacagacggccaggattacctgtggggcaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcaccagggtcgaagccggggatgaggccgactattactgtcagctatgggatggtgggagtgatgtggttttcggcggagggaccaagctgaccgtcctaggt

SEQ ID NO: 1399 - protein, 122 aa, Artificial Sequence
  Description of Artificial Sequence: Synthetic polypeptide
EVQLVQSGAEVKKPGASVNVSCKASGYTFTGYYMHWVRQAPGQGLEWMGWINPNSGGTNYAQKFQGRVTVTTDTSNSTAYMELNRLKSDDTAVYYCAREGSGDLDSLYMDVWGKGTMVTVSS

SEQ ID NO: 1400 - protein, 108 aa, Artificial Sequence
  Description of Artificial Sequence: Synthetic polypeptide
SYELTQPPSVSVAPGQTARITCGANNIGSKSVHWYQQKPGQAPVLVVYDDSDRPSGIPERFSGSNSGNTATLTITRVEAGDEADYYCQLWDGGSDVVFGGGTKLTVLG

SEQ ID NO: 1401 - DNA, 360 bp, Artificial Sequence; identical to SEQ ID NO: 1361
  Description of Artificial Sequence: Synthetic polynucleotide

SEQ ID NO: 1402 - protein, 120 aa, Artificial Sequence; identical to SEQ ID NO: 1362
  Description of Artificial Sequence: Synthetic polypeptide

SEQ ID NO: 1403 - DNA, 333 bp, Artificial Sequence; identical to SEQ ID NO: 1363
  Description of Artificial Sequence: Synthetic polynucleotide

SEQ ID NO: 1404 - protein, 111 aa, Artificial Sequence; identical to SEQ ID NO: 1364
  Description of Artificial Sequence: Synthetic polypeptide

SEQ ID NO: 1405 - protein, 8 aa, Artificial Sequence
  Description of Artificial Sequence: Synthetic peptide
GYTFTDHY

SEQ ID NO: 1406 - protein, 8 aa, Artificial Sequence
  Description of Artificial Sequence: Synthetic peptide
INPSSGGT

SEQ ID NO: 1407 - protein, 13 aa, Artificial Sequence
  Description of Artificial Sequence: Synthetic peptide
ARETIGGWNALDV

SEQ ID NO: 1408 - protein, 8 aa, Artificial Sequence
  Description of Artificial Sequence: Synthetic peptide
SSNIGINT

SEQ ID NO: 1409 - protein, 3 aa, Artificial Sequence
  Description of Artificial Sequence: Synthetic peptide
TNN

SEQ ID NO: 1410 - protein, 11 aa, Artificial Sequence
  Description of Artificial Sequence: Synthetic peptide
AAWDDTLNGPL

SEQ ID NO: 1411 - protein, 8 aa, Artificial Sequence
  Description of Artificial Sequence: Synthetic peptide
GYTFTGYY

SEQ ID NO: 1412 - protein, 8 aa, Artificial Sequence
  Description of Artificial Sequence: Synthetic peptide
INPNSGGT

SEQ ID NO: 1413 - protein, 12 aa, Artificial Sequence
  Description of Artificial Sequence: Synthetic peptide
AREGVHSDAFDV

SEQ ID NO: 1414 - protein, 6 aa, Artificial Sequence
  Description of Artificial Sequence: Synthetic peptide
QSVYTN

SEQ ID NO: 1415 - protein, 3 aa, Artificial Sequence
  Description of Artificial Sequence: Synthetic peptide
GAS

SEQ ID NO: 1416 - protein, 9 aa, Artificial Sequence
  Description of Artificial Sequence: Synthetic peptide
  57
QQYGSSHFT

SEQ ID NO: 1417 - protein, 8 aa, Artificial Sequence
  Description of Artificial Sequence: Synthetic peptide
GYTFTDHY

SEQ ID NO: 1418 - protein, 8 aa, Artificial Sequence
  Description of Artificial Sequence: Synthetic peptide
INPSSGGT

SEQ ID NO: 1419 - protein, 13 aa, Artificial Sequence
  Description of Artificial Sequence: Synthetic peptide
ARETIGGWNALDV

SEQ ID NO: 1420 - protein, 8 aa, Artificial Sequence
  Description of Artificial Sequence: Synthetic peptide
SSTIGRHS

SEQ ID NO: 1421 - protein, 3 aa, Artificial Sequence
  Description of Artificial Sequence: Synthetic peptide
ANN

SEQ ID NO: 1422 - protein, 11 aa, Artificial Sequence
  Description of Artificial Sequence: Synthetic peptide
AAWDDSLSGVL

SEQ ID NO: 1423 - protein, 8 aa, Artificial Sequence
  Description of Artificial Sequence: Synthetic peptide
GYTFTDHY

SEQ ID NO: 1424 - protein, 7 aa, Artificial Sequence
  Description of Artificial Sequence: Synthetic peptide
INPSSGG

SEQ ID NO: 1425 - protein, 13 aa, Artificial Sequence
  Description of Artificial Sequence: Synthetic peptide
ARETIGGWNALDV

SEQ ID NO: 1426 - protein, 6 aa, Artificial Sequence
  Description of Artificial Sequence: Synthetic peptide
KIGTKS

SEQ ID NO: 1427 - protein, 3 aa, Artificial Sequence
  Description of Artificial Sequence: Synthetic peptide
DDR

SEQ ID NO: 1428 - protein, 11 aa, Artificial Sequence
  Description of Artificial Sequence: Synthetic peptide
QVWDSNSDHVV

SEQ ID NO: 1429 - protein, 8 aa, Artificial Sequence
  Description of Artificial Sequence: Synthetic peptide
GYTFTGYY

SEQ ID NO: 1430 - protein, 8 aa, Artificial Sequence
  Description of Artificial Sequence: Synthetic peptide
INPNSGGT

SEQ ID NO: 1431 - protein, 13 aa, Artificial Sequence
  Description of Artificial Sequence: Synthetic peptide
VREVKDYYYYMDV

SEQ ID NO: 1432 - protein, 8 aa, Artificial Sequence
  Description of Artificial Sequence: Synthetic peptide
SGSIASNS

SEQ ID NO: 1433 - protein, 3 aa, Artificial Sequence
  Description of Artificial Sequence: Synthetic peptide
DNK

SEQ ID NO: 1434 - protein, 10 aa, Artificial Sequence
  Description of Artificial Sequence: Synthetic peptide
QSYDDSEQVV

SEQ ID NO: 1435 - protein, 8 aa, Artificial Sequence
  Description of Artificial Sequence: Synthetic peptide
GYTFTGYY

SEQ ID NO: 1436 - protein, 8 aa, Artificial Sequence
  Description of Artificial Sequence: Synthetic peptide
VNPHSGGT

SEQ ID NO: 1437 - protein, 14 aa, Artificial Sequence
  Description of Artificial Sequence: Synthetic peptide
ARETDISANYHFDY

SEQ ID NO: 1438 - protein, 9 aa, Artificial Sequence
  Description of Artificial Sequence: Synthetic peptide
SSDVGSYNA

SEQ ID NO: 1439 - protein, 3 aa, Artificial Sequence
  Description of Artificial Sequence: Synthetic peptide
EVS

SEQ ID NO: 1440 - protein, 11 aa, Artificial Sequence
  Description of Artificial Sequence: Synthetic peptide
ATWDDSLKGPV

SEQ ID NO: 1441 - protein, 8 aa, Artificial Sequence
  Description of Artificial Sequence: Synthetic peptide
GYTFTGYY

SEQ ID NO: 1442 - protein, 8 aa, Artificial Sequence
  Description of Artificial Sequence: Synthetic peptide
INPKTGDT

SEQ ID NO: 1443 - protein, 13 aa, Artificial Sequence
  Description of Artificial Sequence: Synthetic peptide
AREGLSTSSPLDY

SEQ ID NO: 1444 - protein, 6 aa, Artificial Sequence
  Description of Artificial Sequence: Synthetic peptide
ELATNI

SEQ ID NO: 1445 - protein, 3 aa, Artificial Sequence
  Description of Artificial Sequence: Synthetic peptide
HDN

SEQ ID NO: 1446 - protein, 11 aa, Artificial Sequence
  Description of Artificial Sequence: Synthetic peptide
QLWDSASDQVV

SEQ ID NO: 1447 - protein, 8 aa, Artificial Sequence
  Description of Artificial Sequence: Synthetic peptide
GYTFTSHY

SEQ ID NO: 1448 - protein, 8 aa, Artificial Sequence
  Description of Artificial Sequence: Synthetic peptide
INTGNGDT

SEQ ID NO: 1449 - protein, 14 aa, Artificial Sequence
  Description of Artificial Sequence: Synthetic peptide
ARESSSSWFVAFDV

SEQ ID NO: 1450 - protein, 6 aa, Artificial Sequence
  Description of Artificial Sequence: Synthetic peptide
NIRSKR

SEQ ID NO: 1451 - protein, 3 aa, Artificial Sequence
  Description of Artificial Sequence: Synthetic peptide
SDN

SEQ ID NO: 1452 - protein, 11 aa, Artificial Sequence
  Description of Artificial Sequence: Synthetic peptide
QVWDPITDQVV

SEQ ID NO: 1453 - protein, 8 aa, Artificial Sequence
  Description of Artificial Sequence: Synthetic peptide
GYTFTGYY

SEQ ID NO: 1454 - protein, 8 aa, Artificial Sequence
  Description of Artificial Sequence: Synthetic peptide
INPHSGGT

SEQ ID NO: 1455 - protein, 17 aa, Artificial Sequence
  Description of Artificial Sequence: Synthetic peptide
AREIVVVTAPAAAAMDV

SEQ ID NO: 1456 - protein, 9 aa, Artificial Sequence
  Description of Artificial Sequence: Synthetic peptide
SSDVAIYDR

SEQ ID NO: 1457 - protein, 3 aa, Artificial Sequence
  Description of Artificial Sequence: Synthetic peptide
DVH

SEQ ID NO: 1458 - protein, 10 aa, Artificial Sequence
  Description of Artificial Sequence: Synthetic peptide
SSYTTSGTFV

SEQ ID NO: 1459 - protein, 8 aa, Artificial Sequence
  Description of Artificial Sequence: Synthetic peptide
GYTFTGYY

SEQ ID NO: 1460 - protein, 8 aa, Artificial Sequence
  Description of Artificial Sequence: Synthetic peptide
INPNSGGT

SEQ ID NO: 1461 - protein, 15 aa, Artificial Sequence
  Description of Artificial Sequence: Synthetic peptide
AREGSGDLDSLYMDV

SEQ ID NO: 1462 - protein, 6 aa, Artificial Sequence
  Description of Artificial Sequence: Synthetic peptide
NIGSKS

SEQ ID NO: 1463 - protein, 3 aa, Artificial Sequence
  Description of Artificial Sequence: Synthetic peptide
DDS

SEQ ID NO: 1464 - protein, 10 aa, Artificial Sequence
  Description of Artificial Sequence: Synthetic peptide
QLWDGGSDVV

SEQ ID NO: 1465 - protein, 8 aa, Artificial Sequence
  Description of Artificial Sequence: Synthetic peptide
GYTFTDHY

SEQ ID NO: 1466 - protein, 8 aa, Artificial Sequence
  Description of Artificial Sequence: Synthetic peptide
INPSSGGT

SEQ ID NO: 1467 - protein, 13 aa, Artificial Sequence
  Description of Artificial Sequence: Synthetic peptide
ARETIGGWNALDV

SEQ ID NO: 1468 - protein, 8 aa, Artificial Sequence
  Description of Artificial Sequence: Synthetic peptide
SSNIGINT

SEQ ID NO: 1469 - protein, 3 aa, Artificial Sequence
  Description of Artificial Sequence: Synthetic peptide
TNN

SEQ ID NO: 1470 - protein, 11 aa, Artificial Sequence
  Description of Artificial Sequence: Synthetic peptide
AAWDDTLNGPL

SEQ ID NO: 1471 - DNA, 390 bp, Artificial Sequence
  Description of Artificial Sequence: Synthetic polynucleotide
caggtgcagctgttggagtctgggggaggcgtggtccagcctgggaggtccctgagactctcctgtgcagcctctggattcaccttcagtaactatggcatgcactgggtccgccaggctccaggcaaggggctggagtgggtggcaattatatcatttgatggaagtaaaaaatattatgcaaactccgtgaagggccgatccaccatctccagagacaattccaagaacacgctgtctctgcaaatgaacagcctgggacctgaggacacggctctatattactgtgcgaaactgccctccccgtattactttgatagtcggttcgtgtgggtcgccgccagcgcatttcacttctggggccagggaatcctggtcaccgtctcttca

SEQ ID NO: 1472 - protein, 130 aa, Artificial Sequence
  Description of Artificial Sequence: Synthetic polypeptide
QVQLLESGGGVVQPGRSLRLSCAASGFTFSNYGMHWVRQAPGKGLEWVAIISFDGSKKYYANSVKGRSTISRDNSKNTLSLQMNSLGPEDTALYYCAKLPSPYYFDSRFVWVAASAFHFWGQGILVTVSS

SEQ ID NO: 1473 - protein, 110 aa, Artificial Sequence
  Description of Artificial Sequence: Synthetic polypeptide
NFMLTQPPSASGTPGQRVTISCSGSSSNIGGNTVHWFQQLPGTAPKLLIYTNSLRPSGVPDRFSGSKSGTSASLAISGLQSEDEADYYCAAWDDSLNGQVFGGGTKLTVL

SEQ ID NO: 1474 - DNA, 330 bp, Artificial Sequence
  Description of Artificial Sequence: Synthetic polynucleotide
aattttatgctgactcagccaccctcagcgtctgggacccccgggcagagggtcaccatctcttgctctggaagcagctccaacatcggaggtaatactgtacactggttccagcagctcccaggaacggcccccaaactcctcatctatactaatagtctgcggccctcaggggtccctgaccgattctctggctccaagtctggcacctcagcctccctggccatcagtgggctccagtctgaggatgaggctgattattactgtgcagcatgggataacagcctaaatggtcaggtgttcggcggagggaccaagctgaccgtccta

SEQ ID NO: 1475 - protein, 110 aa, Artificial Sequence
  Description of Artificial Sequence: Synthetic polypeptide
NFMLTQPPSASGTPGQRVTISCSGSSSNIGGNTVHWFQQLPGTAPKLLIYTNSLRPSGVPDRFSGSKSGTSASLAISGLQSEDEADYYCAAWDNSLNGQVFGGGTKLTVL

SEQ ID NO: 1476 - protein, 8 aa, Artificial Sequence
  Description of Artificial Sequence: Synthetic peptide
GFTFSNYG

SEQ ID NO: 1477 - protein, 8 aa, Artificial Sequence
  Description of Artificial Sequence: Synthetic peptide
ISFDGSKK

SEQ ID NO: 1478 - protein, 25 aa, Artificial Sequence
  Description of Artificial Sequence: Synthetic peptide
CAKLPSPYYFDSRFVWVAASAFHFW

SEQ ID NO: 1479 - protein, 8 aa, Artificial Sequence
  Description of Artificial Sequence: Synthetic peptide
SSNIGGNT

SEQ ID NO: 1480 - protein, 3 aa, Artificial Sequence
  Description of Artificial Sequence: Synthetic peptide
TNS

SEQ ID NO: 1481 - protein, 13 aa, Artificial Sequence [sequence omitted]

SEQ ID NO: 1482 - protein, 13 aa, Artificial Sequence
  Description of Artificial Sequence: Synthetic peptide
  1453
CAAWDNSLNGQVF

SEQ ID NO: 1483 - protein, 7 aa, Artificial Sequence
  Description of Artificial Sequence: Synthetic peptide
GNTNRPS

SEQ ID NO: 1484 - protein, 5 aa, Artificial Sequence
  Description of Artificial Sequence: Synthetic peptide
GGGGS

SEQ ID NO: 1485 - DNA, 372 bp, Artificial Sequence
  Description of Artificial Sequence: Synthetic Variable heavy chain of Ab-14
caggtgcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagctctacctagtgggactatactggtcggaggttggttcgacccctggggccagggaaccctggtcaccgtctcctca

SEQ ID NO: 1486 - protein, 124 aa, Artificial Sequence
  Description of Artificial Sequence: Synthetic Variable heavy chain of Ab-14
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARALPSGTILVGGWFDPWGQGTLVTVSS

SEQ ID NO: 1487 - DNA, 333 bp, Artificial Sequence
  Description of Artificial Sequence: Synthetic Variable light chain of Ab-14
aattttatgctgactcagccccactctgtgtcggagtctccggggaagacggtaaccatctcctgcacccgcagcagtggcaacattgccagcaattatgtgcagtggtaccaacagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatctttgggtgttcggcggagggaccaagctgaccgtccta

SEQ ID NO: 1488 - protein, 111 aa, Artificial Sequence
  Description of Artificial Sequence: Synthetic Variable light chain of Ab-14
NFMLTQPHSVSESPGKTVTISCTRSSGNIASNYVQWYQQRPGSAPTTVIYEDNQRPSGVPDRFSGSIDSSSNSASLTISGLKTEDEADYYCQSYDSSNLWVFGGGTKLTVL

SEQ ID NO: 1489 - DNA, 372 bp, Artificial Sequence
  Description of Artificial Sequence: Synthetic Variable heavy chain of Ab-16
gaggtgcagctggtgcagtctgggggaggcgtggtccagcctgggaggtccctgagactctcctgtgcagcctctggattcacctttagcagctatgccctgagctgggtccgccaggctccagggaaggggctggagtgggtctcagctattagtggtggtggtggtagcacatactacgcagactccgtgaagggccggttcaccatctccagagacaattccaagaacacgctgtatctgcaaatgaacagcctgagagccgaggacacggccgtatattactgtgcgaaagacgtgtttccagagactttttcgatgaactacggtatggacgtctggggccaaggaaccctggtcaccgtctcctca

SEQ ID NO: 1490 - protein, 124 aa, Artificial Sequence
  Description of Artificial Sequence: Synthetic Variable heavy chain Ab-16
EVQLVQSGGGVVQPGRSLRLSCAASGFTFSSYALSWVRQAPGKGLEWVSAISGGGGSTYYADSVKGRFTISRDNSKNTLYLQMNSLRAEDTAVYYCAKDVFPETFSMNYGMDVWGQGTLVTVSS

SEQ ID NO: 1491 - DNA, 324 bp, Artificial Sequence
  Description of Artificial Sequence: Synthetic Variable light chain of Ab-16
tcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtaaccattatgtcttcggaactgggaccaaggtcaccgtccta

SEQ ID NO: 1492 - protein, 108 aa, Artificial Sequence
  Description of Artificial Sequence: Synthetic Variable light chain of Ab-16
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHYVFGTGTKVTVL

SEQ ID NO: 1493 - DNA, 384 bp, Artificial Sequence
  Description of Artificial Sequence: Synthetic Variable heavy chain of Ab-22
caggtgcagctggtgcagtctgggggaggcgtggtacagcctggggggtccctgagactctcctgtgcagcctctggattcacctttgatgattatgccatgcactgggtccgtcaagctccagggaagggtctggagtgggtctctcttattagtggggatggtggtagcacatactatgcagactctgtgaagggccgattcaccatctccagagacaacagcaaaaactccctgtatctgcaaatgaacagtctgagaactgaggacaccgccttgtattactgtgcaaaagtgctcctcccctgtagtagtaccagctgctatggaagcgtcggtgcttttgatatctggggccaagggaccacggtcaccgtctcctca

SEQ ID NO: 1494 - protein, 128 aa, Artificial Sequence
  Description of Artificial Sequence: Synthetic Variable heavy chain of Ab-22
QVQLVQSGGGVVQPGGSLRLSCAASGFTFDDYAMHWVRQAPGKGLEWVSLISGDGGSTYYADSVKGRFTISRDNSKNSLYLQMNSLRTEDTALYYCAKVLLPCSSTSCYGSVGAFDIWGQGTTVTVSS

SEQ ID NO: 1495 - DNA, 324 bp, Artificial Sequence
  Description of Artificial Sequence: Synthetic Variable light chain Ab-22
taggacgatgagctcggtcccagctccgaagacataatgatcactattattatcccacacctgacagtaataatcggcctcatcaccggcttcgaccctgctgatggtcagggtggccgtgttcccagagttggagccagagaatcgctcagagatccctgagggccggtccctatcagagtagatgaccaacgcaggggcctggcctggcttctgctggtaccagtgcacactcttccttccaatgtcgcttcccccacaggtaatcctggccgtctttcctggggccactgacactgagggtgcctgagtcagcacaggcag

SEQ ID NO: 1496 - protein, 108 aa, Artificial Sequence
  Description of Artificial Sequence: Synthetic Variable light chain of Ab-22
LPVLTQAPSVSVAPGKTARITCGGSDIGRKSVHWYQQKPGQAPALVIYSDRDRPSGISERFSGSNSGNTATLTISRVEAGDEADYYCQVWDNNSDHYVFGAGTELIVL

SEQ ID NO: 1497 - DNA, 351 bp, Artificial Sequence
  Description of Artificial Sequence: Synthetic Variable heavy chain of Ab-30
caggtgcagctggtgcagtctgggggaagtgtggtacggcctggggaatccctcagactctcctgtgtagcctctggattcatctttgataattatgacatgagttgggtccgccaagttccagggaaggggctggagtgggtctctcgtgttaattggaatggtggtagcacaacttatgcagacgctgtgaagggccgattcaccatctccagagacaacaccaagaactccctgtatctacaaatgaacaacctgagagccgaagacacggccgtgtattactgtgtgcgcgagtttgtcggtgcttatgatctctggggccaggggaccacggtcaccgtctcctca

SEQ ID NO: 1498 - protein, 117 aa, Artificial Sequence
  Description of Artificial Sequence: Synthetic Variable heavy chain of Ab-30
QVQLVQSGGSVVRPGESLRLSCVASGFIFDNYDMSWVRQVPGKGLEWVSRVNWNGGSTTYADAVKGRFTISRDNTKNSLYLQMNNLRAEDTAVYYCVREFVGAYDLWGQGTTVTVSS

SEQ ID NO: 1499 - DNA, 327 bp, Artificial Sequence
  Description of Artificial Sequence: Synthetic Variable light chain of Ab-30
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcactctgccgttcggcggagggaccaagctgaccgtccta

SEQ ID NO: 1500 - protein, 109 aa, Artificial Sequence
  Description of Artificial Sequence: Synthetic Variable light chain of Ab-30
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSTLPFGGGTKLTVL

SEQ ID NO: 1501 - DNA, 363 bp, Artificial Sequence
  Description of Artificial Sequence: Synthetic Variable heavy chain of Ab-31
caggtgcagctggtgcagtctggggctgaggtgaagaagccaggggccacagtgaaggtctcctgcaaggtttttggagacaccttccgcggcctctatatacactgggtgcgacaggcccctggacaagggcttgagtggatgggagggatcatccctatctttggtacagcaaactacgcacagaagttccagggcagagtcacgattaccacggacgaatccacgagcacagcctacatggagctgagcagcctgagatctgaggacacggccgtgtattactgtgcgagcggactacgttgggggatctggggctggttcgacccctggggccagggcaccctggtcaccgtctcctca

SEQ ID NO: 1502 - protein, 121 aa, Artificial Sequence
  Description of Artificial Sequence: Synthetic Variable heavy chain of Ab-31
QVQLVQSGAEVKKPGATVKVSCKVFGDTFRGLYIHWVRQAPGQGLEWMGGIIPIFGTANYAQKFQGRVTITTDESTSTAYMELSSLRSEDTAVYYCASGLRWGIWGWFDPWGQGTLVTVSS

SEQ ID NO: 1503 - DNA, 321 bp, Artificial Sequence
  Description of Artificial Sequence: Synthetic Variable light chain of Ab-31
gaaattgtgttgacgcagtctccagccaccctgtctttgtctccaggggaaagagccaccctctcctgcagggccagtcagagtattggcaacagcttagcctggtaccagcagaaacctggccaggctcccaggctcctcatgtatggtgcatccagcagggccactggcatcccagacaggttcagtggcagtggggctgggacagacttcactctcaccatcagcagcctagagcctgaagattttgcaacgtattactgtcagcagcatactatcccaacattctctttcggccctgggaccaaagtggaagtcaaa

SEQ ID NO: 1504 - protein, 107 aa, Artificial Sequence
  Description of Artificial Sequence: Synthetic Variable light chain of Ab-31
EIVLTQSPATLSLSPGERATLSCRASQSIGNSLAWYQQKPGQAPRLLMYGASSRATGIPDRFSGSGAGTDFTLTISSLEPEDFATYYCQQHTIPTFSFGPGTKVEVK

SEQ ID NO: 1505 - DNA, 363 bp, Artificial Sequence
  Description of Artificial Sequence: Synthetic Variable heavy chain of Ab-32
gaggtgcagctggtgcagtctggggctgagctgaagaagcctgggtcctcggtgaaggtctcctgcaaggcttttggaggcaccttcagtgacaatgctatcagctgggtgcgacaggcccctggacaagggcctgagtggatggggggcatcattcctatctttggaaaaccaaactacgcacagaagttccagggcagagtcacgattaccgcggacgaatccacgagcactgcctacatggtcctgagcagcctgagatctgaggacacggccgtatattactgtgcgagaactatggttcggggctttcttggggttatggacgtctggggccaagggaccacggtcaccgtctcctca

SEQ ID NO: 1506 - protein, 121 aa, Artificial Sequence
  Description of Artificial Sequence: Synthetic Variable heavy chain of Ab-32
EVQLVQSGAELKKPGSSVKVSCKAFGGTFSDNAISWVRQAPGQGPEWMGGIIPIFGKPNYAQKFQGRVTITADESTSTAYMVLSSLRSEDTAVYYCARTMVRGFLGVMDVWGQGTTVTVSS

SEQ ID NO: 1507 - DNA, 321 bp, Artificial Sequence
  Description of Artificial Sequence: Synthetic Variable light chain of Ab-32
gatattgtgatgacccagactccatccttcctgtccgcatccataggagacagagtcaccatcacttgccgggccagtcagggcattggcagttatttagcctggtatcagcaaagaccaggggaagcccctaagctcctgatctatgctgcatcgactttgcaaagtggagtcccatcaaggttcagcggcagtggatctgggacggacttcactctcacaatcagcaacctgcagcctgaagattttgcaacttattactgtcaacagcttaataattacccgatcaccttcggccaagggacacgactggagattaaa

SEQ ID NO: 1508 - protein, 107 aa, Artificial Sequence
  Description of Artificial Sequence: Synthetic Variable light chain of Ab-32
DIVMTQTPSFLSASIGDRVTITCRASQGIGSYLAWYQQRPGEAPKLLIYAASTLQSGVPSRFSGSGSGTDFTLTISNLQPEDFATYYCQQLNNYPITFGQGTRLEIK

SEQ ID NO: 1509 - DNA, 375 bp, Artificial Sequence
  Description of Artificial Sequence: Synthetic Variable heavy chain of Ab-38
caggtgcagctggtgcagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagatcagttcgttacgatttttggagtgccaagatacggtatggacgtctggggccaagggaccacggtcaccgtctcctca

SEQ ID NO: 1510 - protein, 125 aa, Artificial Sequence
  Description of Artificial Sequence: Synthetic Variable heavy chain of Ab-38
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKDQFVTIFGVPRYGMDVWGQGTTVTVSS

SEQ ID NO: 1511 - DNA, 315 bp, Artificial Sequence
  Description of Artificial Sequence: Synthetic Variable light chain of Ab-38
cagtctgccctgactcagccaccctcagtgtccgtgtccccaggacagacagccaacatcccctgctctggagataaattggggaataaatatgcttactggtatcagcagaagccaggccagtcccctgtactgctcatctatcaagatatcaagcggccctcaaggatccctgagcgattctctggctccaactctgcggacacagccactctgaccatcagcgggacccaggctatggatgaggctgactattactgtcagacgtgggacaacagcgtggtcttcggcggcgggaccaagctgaccgtcctc

SEQ ID NO: 1512 - protein, 105 aa, Artificial Sequence
  Description of Artificial Sequence: Synthetic Variable light chain of Ab-38
QSALTQPPSVSVSPGQTANIPCSGDKLGNKYAYWYQQKPGQSPVLLIYQDIKRPSRIPERFSGSNSADTATLTISGTQAMDEADYYCQTWDNSVVFGGGTKLTVL

SEQ ID NO: 1513 - DNA, 360 bp, Artificial Sequence
  Description of Artificial Sequence: Synthetic Variable heavy chain of Ab-42
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtctattactgtgcgagagggcgtcaaatgttcggtgcgggaattgatttctggggcccgggcaccctggtcaccgtctcctca

SEQ ID NO: 1514 - protein, 120 aa, Artificial Sequence
  Description of Artificial Sequence: Synthetic Variable heavy chain of Ab-42
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARGRQMFGAGIDFWGPGTLVTVSS

SEQ ID NO: 1515 - DNA, 336 bp, Artificial Sequence
  Description of Artificial Sequence: Synthetic Variable light chain of Ab-42
aattttatgctgactcagccccactctgtgtcggagtctccggggaagacggtaaccatctcctgcacccgcagcagtggcagcattgacagcaactatgtgcagtggtaccagcagcgcccgggcagcgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcaacaatcgtcatgtgatattcggcggagggaccaagctgaccgtccta

SEQ ID NO: 1516 - protein, 112 aa, Artificial Sequence
  Description of Artificial Sequence: Synthetic Variable light chain of Ab-42
NFMLTQPHSVSESPGKTVTISCTRSSGSIDSNYVQWYQQRPGSAPTTVIYEDNQRPSGVPDRFSGSIDSSSNSASLTISGLKTEDEADYYCQSYDSNNRHVIFGGGTKLTVL

SEQ ID NO: 1517 - DNA, 354 bp, Artificial Sequence
  Description of Artificial Sequence: Synthetic Variable heavy chain of Ab-46
gaggtgcagctggtggagtctggggctgaagtaaagaagcctgggtcctcggtgaaagtctcctgcaaggtttcaggaggcacattcggcacctatgctctcaactgggtgcgccaggcccctggacaagggcttgagtggatgggaaggatcgtccctctcattggtctagtaaactacgcacataactttgagggcagaatctcgattaccgcggacaagtccacgggcacagcctacatggaactgagcaacctgagatctgacgacacggccgtgtattactgtgcgagagaggtctacggtggtaactccgactactggggccagggaaccctggtcaccgtctcctca

SEQ ID NO: 1518 - protein, 118 aa, Artificial Sequence
  Description of Artificial Sequence: Synthetic Variable heavy chain of Ab-46
EVQLVESGAEVKKPGSSVKVSCKVSGGTFGTYALNWVRQAPGQGLEWMGRIVPLIGLVNYAHNFEGRISITADKSTGTAYMELSNLRSDDTAVYYCAREVYGGNSDYWGQGTLVTVSS

SEQ ID NO: 1519 - DNA, 330 bp, Artificial Sequence
  Description of Artificial Sequence: Synthetic Variable light chain of Ab-46
aattttatgctgactcagccccactcagtgtcggagtctccggggaagacggtaaccatctcctgcactcgcagtagtggcaacattggcaccaactatgtgcagtggtaccagcagcgcccgggcagtgcccccgtcgctttgatctacgaggattatcgaagaccctctggggtccctgatcggttctctggctccatcgacagctcctccaactctgcctccctcatcatctctggactgaagcctgaggacgaggctgactactactgtcagtcttatcatagcagcggttgggaattcggcggagggaccaagctgaccgtcctc

SEQ ID NO: 1520 - protein, 110 aa, Artificial Sequence
  Description of Artificial Sequence: Synthetic Variable light chain of Ab-46
NFMLTQPHSVSESPGKTVTISCTRSSGNIGTNYVQWYQQRPGSAPVALIYEDYRRPSGVPDRFSGSIDSSSNSASLIISGLKPEDEADYYCQSYHSSGWEFGGGTKLTVL

SEQ ID NO: 1521 - DNA, 360 bp, Artificial Sequence
  Description of Artificial Sequence: Synthetic Variable heavy chain of Ab-50
caggtgcagctggtgcagtctggaggtgaggtgaagaagccgggggcctcagtgaaggtctcctgcaaggcttctggttacaccttgagcagtcatggtataacctgggtgcgacaggcccctggacaagggcttgagtggatgggatggatcagcgctcacaatggtcacgctagcaatgcacagaaggtggaggacagagtcactatgactactgacacatccacgaacacagcctacatggaactgaggagcctgacagctgacgacacggccgtgtattactgtgcgagagtacatgctgccctctactatggtatggacgtctggggccaaggaaccctggtcaccgtctcctca

SEQ ID NO: 1522 - protein, 120 aa, Artificial Sequence
  Description of Artificial Sequence: Synthetic Variable heavy chain of Ab-50
QVQLVQSGGEVKKPGASVKVSCKASGYTLSSHGITWVRQAPGQGLEWMGWISAHNGHASNAQKVEDRVTMTTDTSTNTAYMELRSLTADDTAVYYCARVHAALYYGMDVWGQGTLVTVSS

SEQ ID NO: 1523 - DNA, 324 bp, Artificial Sequence
  Description of Artificial Sequence: Synthetic Variable light chain of Ab-50
cagtctgtgctgactcagccaccctcggtgtcagtggccccaggacagacggccaggattacctgtgggggaaacaacattggaagtaaaggtgtgcactggtatcagcagaagccaggccaggcccctgtactggtcgtctatgatgatagtgaccggccctcagggatccctgagcgattctctggctccaactctgggaacacggccaccctgaccatcagcagggtcgaagccggggatgaggccgactattactgtcaggtgtgggatagtagtagtgatcattgggtgttcggcggagggaccaagctgaccgtccta

SEQ ID NO: 1524 - protein, 108 aa, Artificial Sequence
  Description of Artificial Sequence: Synthetic Variable light chain of Ab-50
QSVLTQPPSVSVAPGQTARITCGGNNIGSKGVHWYQQKPGQAPVLVVYDDSDRPSGIPERFSGSNSGNTATLTISRVEAGDEADYYCQVWDSSSDHWVFGGGTKLTVL

SEQ ID NO: 1525 - DNA, 363 bp, Artificial Sequence
  Description of Artificial Sequence: Synthetic Variable heavy chain of Ab-52
caggtgcagctgcaggagtcggggggaggcgtggtgcagcctgggaggtccctgagactctcctgttcagcctctggattcaccttcagcagacatggcatgcactgggtccgccaggctccaggcaaggggctggagtgggtggcagtgatatcacatgatggaagtgtaaaatactatgcagactccatgaagggccgattcagcatctccagagacaattccaacaacacactgtatctccaaatggacagcctgagagctgacgacacggccgtttattactgtgcgagaggactgtcgtaccaggtgtcggggtggttcgacccctggggccagggcaccctggtcaccgtctcctca

SEQ ID NO: 1526 - protein, 121 aa, Artificial Sequence
  Description of Artificial Sequence: Synthetic Variable heavy chain of Ab-52
QVQLQESGGGVVQPGRSLRLSCSASGFTFSRHGMHWVRQAPGKGLEWVAVISHDGSVKYYADSMKGRFSISRDNSNNTLYLQMDSLRADDTAVYYCARGLSYQVSGWFDPWGQGTLVTVSS

SEQ ID NO: 1527 - DNA, 333 bp, Artificial Sequence
  Description of Artificial Sequence: Synthetic Variable light chain of Ab-52
aattttatgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcaccaccccttcggtgttcggcggcgggaccaagctgaccgtccta

SEQ ID NO: 1528 - protein, 111 aa, Artificial Sequence
  Description of Artificial Sequence: Synthetic Variable light chain of Ab-52
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSTTPSVFGGGTKLTVL

SEQ ID NO: 1529 - DNA, 360 bp, Artificial Sequence
  Description of Artificial Sequence: Synthetic Variable heavy chain of Ab-55
caggtgcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggaccagccctcataatggtctcacagcatttgcacagatcctagagggccgagtcaccatgaccacagacacatccacgaacacagcctacatggaattgaggaacctgacatttgatgacacggccgtttatttctgtgcgaaagtacatcctgtcttctcttatgcgttggacgtctggggccaaggcaccctggtcaccgtctcctca

SEQ ID NO: 1530 - protein, 120 aa, Artificial Sequence
  Description of Artificial Sequence: Synthetic Variable heavy chain of Ab-55
QVQLVQSGAEVKKPGASVKVSCKASGYTFTSYGISWVRQAPGQGLEWMGWTSPHNGLTAFAQILEGRVTMTTDTSTNTAYMELRNLTFDDTAVYFCAKVHPVFSYALDVWGQGTLVTVSS

SEQ ID NO: 1531 - DNA, 330 bp, Artificial Sequence
  Description of Artificial Sequence: Synthetic Variable light chain of Ab-55
aattttatgctgactcagccccactctgtgtcggagtccccggggaagacggtaaccatctcctgcacccgcagcagtggcagcattgccagcaactatgtacagtggtaccagcagcgcccgggcagttcccccaccactgtgatctatgaagataaccaaagaccctctggggtccctgatcggttctctggctccatcgacacctcctccaactctgcctccctcaccatctctggactgaagactaaggacgaggcggactactactgtcagtcttatgatggcatcactgtgattttcggcggagggaccaagttgaccgtccta

SEQ ID NO: 1532 - protein, 110 aa, Artificial Sequence
  Description of Artificial Sequence: Synthetic Variable light chain of Ab-55
NFMLTQPHSVSESPGKTVTISCTRSSGSIASNYVQWYQQRPGSSPTTVIYEDNQRPSGVPDRFSGSIDTSSNSASLTISGLKTKDEADYYCQSYDGITVIFGGGTKLTVL

SEQ ID NO: 1533 - DNA, 354 bp, Artificial Sequence
  Description of Artificial Sequence: Synthetic Variable heavy chain of Ab-56
gaggtgcagctggtggagtctggagctgaggtgatgaaccctgggtcctcggtgagggtctcctgcaggggttctggaggcgacttcagtacctatgctttcagctgggtgcgacaggcccctggacaagggcttgagtggatgggaaggatcatccctatccttggtatagcaaactacgcacagaagttccagggcagggtcacgattaccgcggacaaatccacgagcacagcctacatggagctgagcagcctgagatctgacgatacggccgtgtattactgtgcgagagatggctatggttcggacccggtgctatggggccagggcaccctggtcaccgtctcctca

SEQ ID NO: 1534 - protein, 118 aa, Artificial Sequence
  Description of Artificial Sequence: Synthetic Variable heavy chain of Ab-56
EVQLVESGAEVMNPGSSVRVSCRGSGGDFSTYAFSWVRQAPGQGLEWMGRIIPILGIANYAQKFQGRVTITADKSTSTAYMELSSLRSDDTAVYYCARDGYGSDPVLWGQGTLVTVSS

SEQ ID NO: 1535 - DNA, 333 bp, Artificial Sequence
  Description of Artificial Sequence: Synthetic Variable light chain of Ab-56
aattttatgctgactcagccccactctgtgtcggggtctccggggaagacggtaaccctcccctgcacccgcagcagtggcagcattgccagccactatgtccagtggtaccagcagcgcccgggcagtgcccccaccactgtgatctatgaggataacaagagaccctctggggtccctgatcggttctctggctccatcgacagctcctccaactctgcctccctcagcatctctggactgaagactgaggacgaggctgactactactgtcagtcttatgatagcagcaatcgttgggtgttcggcggagggaccaagctgaccgtccta

SEQ ID NO: 1536 - protein, 111 aa, Artificial Sequence
  Description of Artificial Sequence: Synthetic Variable light chain of Ab-56
NFMLTQPHSVSGSPGKTVTLPCTRSSGSIASHYVQWYQQRPGSAPTTVIYEDNKRPSGVPDRFSGSIDSSSNSASLSISGLKTEDEADYYCQSYDSSNRWVFGGGTKLTVL

SEQ ID NO: 1537 - DNA, 354 bp, Artificial Sequence
  Description of Artificial Sequence: Synthetic Variable heavy chain of Ab-65
gaggtgcagctggtgcagtctggagctgaggtgaagaagcctggggcctcagtgaaggtctcctgcaaggcttctggttacacctttaccaactatggtatcagctgggtgcgacaggcccctggacaagggcttgagtggatgggatggatcagcgcttacaatggtaacacaaactatgcacagaaggtccagggcagagtcaccatgaccacagacacatccacgagcacaggctacatggagctgaggagcctgagatctgacgacacggccgtgtattactgtgcgagaggagattttcggaaaccctttgactactggggccagggaaccctggtcaccgtctcctca

SEQ ID NO: 1538 - protein, 118 aa, Artificial Sequence
  Description of Artificial Sequence: Synthetic Variable heavy chain of Ab-65
EVQLVQSGAEVKKPGASVKVSCKASGYTFTNYGISWVRQAPGQGLEWMGWISAYNGNTNYAQKVQGRVTMTTDTSTSTGYMELRSLRSDDTAVYYCARGDFRKPFDYWGQGTLVTVSS

SEQ ID NO: 1539 - DNA, 345 bp, Artificial Sequence
  Description of Artificial Sequence: Synthetic Variable light chain of Ab-65
ctgcctgtgctgactcagccggcttccctctctgcatcccccggagcatcagccagtctcacctgcaccttacgcagtggcctcaatgttggttcctacaggatatactggtaccagcagaagccagggagtcgtccccagtatctcctgaactacaaatcagactcaaataaacagcaggcctctggagtccccagccgcttctctggatccaaggatgcttcggccaatgcagggattttactcatctccgggctccagtctgaggatgaggctgactattactgtatgatttggtacagcagcgctgtggtattcggcggagggaccaagctgaccgtccta

SEQ ID NO: 1540 - protein, 115 aa, Artificial Sequence
  Description of Artificial Sequence: Synthetic Variable light chain of Ab-65
LPVLTQPASLSASPGASASLTCTLRSGLNVGSYRIYWYQQKPGSRPQYLLNYKSDSNKQQASGVPSRFSGSKDASANAGILLISGLQSEDEADYYCMIWYSSAVVFGGGTKLTVL

SEQ ID NO: 1541 - protein, 5 aa, Artificial Sequence
  Description of Artificial Sequence: Synthetic Heavy chain CDR1 consensus, Ab-42
SYAIS

SEQ ID NO: 1542 - protein, 5 aa, Artificial Sequence
  Description of Artificial Sequence: Synthetic Heavy chain CDR1 of Ab-14, Ab-55
SYGIS

SEQ ID NO: 1543 - protein, 5 aa, Artificial Sequence
  Description of Artificial Sequence: Synthetic Heavy chain CDR1 of Ab-16
SYALS

SEQ ID NO: 1544 - protein, 5 aa, Artificial Sequence
  Description of Artificial Sequence: Synthetic Heavy chain CDR1 of Ab-22
DYAMH

SEQ ID NO: 1545 - protein, 5 aa, Artificial Sequence
  Description of Artificial Sequence: Synthetic Heavy chain CDR1 of Ab-30
NYDMS

SEQ ID NO: 1546 - protein, 5 aa, Artificial Sequence
  Description of Artificial Sequence: Synthetic Heavy chain CDR1 of Ab-31
GLYIH

SEQ ID NO: 1547 - protein, 5 aa, Artificial Sequence
  Description of Artificial Sequence: Synthetic Heavy chain CDR1 of Ab-32
DNAIS

SEQ ID NO: 1548 - protein, 5 aa, Artificial Sequence
  Description of Artificial Sequence: Synthetic Heavy chain CDR1 of Ab-38
SYAMS

SEQ ID NO: 1549 - protein, 5 aa, Artificial Sequence
  Description of Artificial Sequence: Synthetic Heavy chain CDR1 of Ab-46
TYALN

SEQ ID NO: 1550 - protein, 5 aa, Artificial Sequence
  Description of Artificial Sequence: Synthetic Heavy chain CDR1 of Ab-50
SHGIT

SEQ ID NO: 1551 - protein, 5 aa, Artificial Sequence
  Description of Artificial Sequence: Synthetic Heavy chain CDR1 Ab-52
RHGMH

SEQ ID NO: 1552 - protein, 5 aa, Artificial Sequence
  Description of Artificial Sequence: Synthetic Heavy chain CDR1 of Ab-56
TYAFS

SEQ ID NO: 1553 - protein, 5 aa, Artificial Sequence
  Description of Artificial Sequence: Synthetic Heavy chain CDR1 of Ab-65
NYGIS

SEQ ID NO: 1554 - protein, 17 aa, Artificial Sequence
  Description of Artificial Sequence: Synthetic Heavy chain CDR2 consensus
WISPIGGSTNYAQKVQG

SEQ ID NO: 1555 - protein, 17 aa, Artificial Sequence
  Description of Artificial Sequence: Synthetic Heavy chain CDR2 of Ab-14
WISAYNGNTNYAQKLED

SEQ ID NO: 1556 - protein, 17 aa, Artificial Sequence
  Description of Artificial Sequence: Synthetic Heavy chain CDR2 of Ab-16
AISGGGGSTYYADSVKD

SEQ ID NO: 1557 - protein, 17 aa, Artificial Sequence
  Description of Artificial Sequence: Synthetic Heavy chain CDR2 of Ab-22
LISGDGGSTYYADSVKD

SEQ ID NO: 1558 - protein, 17 aa, Artificial Sequence
  Description of Artificial Sequence: Synthetic Heavy chain CDR2 of Ab-30
RVNWNGGSTTYADAVKD

SEQ ID NO: 1559 - protein, 17 aa, Artificial Sequence
  Description of Artificial Sequence: Synthetic Heavy chain CDR2 of Ab-31
WIIPIFGTANYAQKFED

SEQ ID NO: 1560 - protein, 17 aa, Artificial Sequence
  Description of Artificial Sequence: Synthetic Heavy chain CDR2 of Ab-32
WIIPIFGKPNYAQKFED

SEQ ID NO: 1561 - protein, 17 aa, Artificial Sequence
  Description of Artificial Sequence: Synthetic Heavy chain CDR2 of Ab-38
AISGSGGSTYYADSVKD

SEQ ID NO: 1562 - protein, 17 aa, Artificial Sequence
  Description of Artificial Sequence: Synthetic Heavy chain CDR2 of Ab-42
WIIPIFGTANYAQKFED

SEQ ID NO: 1563 - protein, 17 aa, Artificial Sequence
  Description of Artificial Sequence: Synthetic Heavy chain CDR2 of Ab-46
RIVPLIGLVNYAHNFED

SEQ ID NO: 1564 - protein, 17 aa, Artificial Sequence
  Description of Artificial Sequence: Synthetic Heavy chain CDR2 of Ab-50
WISAHNGHASNAQKVED

SEQ ID NO: 1565 - protein, 17 aa, Artificial Sequence
  Description of Artificial Sequence: Synthetic Heavy chain CDR2 of Ab-52
VISHDGSVKYYADSMKD

SEQ ID NO: 1566 - protein, 17 aa, Artificial Sequence
  Description of Artificial Sequence: Synthetic Heavy chain CDR2 of Ab-55
WTSPHNGLTAFAQILED

SEQ ID NO: 1567 - protein, 17 aa, Artificial Sequence
  Description of Artificial Sequence: Synthetic Heavy chain CDR2 of Ab-56
RIIPILGIANYAQKFED

SEQ ID NO: 1568 - protein, 17 aa, Artificial Sequence
  Description of Artificial Sequence: Synthetic Heavy chain CDR2 of Ab-65
WISAYNGNTNYAQKVED

SEQ ID NO: 1569 - protein, 19 aa, Artificial Sequence
  Description of Artificial Sequence: Synthetic Heavy chain CDR3 consensus
  MOD_RES (3)..(17): Any naturally occurring amino acid
GLXXXXXXXXXXXXXXXDV

SEQ ID NO: 1570 - protein, 15 aa, Artificial Sequence
  Description of Artificial Sequence: Synthetic Heavy chain CDR3 of Ab-14
ALPSGTILVGGWFDP

SEQ ID NO: 1571 - protein, 15 aa, Artificial Sequence
  Description of Artificial Sequence: Synthetic Heavy chain CDR3 of Ab-16
DVFPETFSMNYGMDV

SEQ ID NO: 1572 - protein, 19 aa, Artificial Sequence
  Description of Artificial Sequence: Synthetic Heavy chain CDR3 of Ab-22
VLLPCSSTSCYGSVGAFDI

SEQ ID NO: 1573 - protein, 8 aa, Artificial Sequence
  Description of Artificial Sequence: Synthetic Heavy chain CDR3 of Ab-30
EFVGAYDL

SEQ ID NO: 1574 - protein, 12 aa, Artificial Sequence
  Description of Artificial Sequence: Synthetic Heavy chain CDR3 of Ab-31
GLRWGIWGWFDP

SEQ ID NO: 1575 - protein, 12 aa, Artificial Sequence
  Description of Artificial Sequence: Synthetic Heavy chain CDR3 of Ab-32
TMVRGFLGVMDV

SEQ ID NO: 1576 - protein, 16 aa, Artificial Sequence
  Description of Artificial Sequence: Synthetic Heavy chain CDR3 of Ab-38
DQFVTIFGVPRYGMDV

SEQ ID NO: 1577 - protein, 11 aa, Artificial Sequence
  Description of Artificial Sequence: Synthetic Heavy chain CDR3 of Ab-42
GRQMFGAGIDF

SEQ ID NO: 1578 - protein, 9 aa, Artificial Sequence
  Description of Artificial Sequence: Synthetic Heavy chain CDR3 of Ab-46
EVYGGNSDY

SEQ ID NO: 1579 - protein, 11 aa, Artificial Sequence
  Description of Artificial Sequence: Synthetic Heavy chain CDR3 of Ab-50
VHAALYYGMDV

SEQ ID NO: 1580 - protein, 12 aa, Artificial Sequence
  Description of Artificial Sequence: Synthetic Heavy chain CDR3 of Ab-52
GLSYQVSGWFDP

SEQ ID NO: 1581 - protein, 11 aa, Artificial Sequence
  Description of Artificial Sequence: Synthetic Heavy chain CDR3 of Ab-55
VHPVFSYALDV

SEQ ID NO: 1582 - protein, 9 aa, Artificial Sequence
  Description of Artificial Sequence: Synthetic Heavy chain CDR3 of Ab-56
DGYGSDPVL

SEQ ID NO: 1583 - protein, 9 aa, Artificial Sequence
  Description of Artificial Sequence: Synthetic Heavy chain CDR3 of Ab-65
GDFRKPFDY

SEQ ID NO: 1584 - protein, 13 aa, Artificial Sequence
  Description of Artificial Sequence: Synthetic Light chain CDR1 consensus
TRSSGSIGSNYVQ

SEQ ID NO: 1585 - protein, 13 aa, Artificial Sequence
  Description of Artificial Sequence: Synthetic Light chain CDR1 of Ab-14
TRSSGNIASNYVQ

SEQ ID NO: 1586 - protein, 11 aa, Artificial Sequence
  Description of Artificial Sequence: Synthetic Light chain CDR1 of Ab-16
QGDSLRSYYAS

SEQ ID NO: 1587 - protein, 11 aa, Artificial Sequence
  Description of Artificial Sequence: Synthetic Light chain CDR1 of Ab-22
GGSDIGRKSVH

SEQ ID NO: 1588 - protein, 14 aa, Artificial Sequence
  Description of Artificial Sequence: Synthetic Light chain CDR1 of Ab-30
TGTSSDVGGYNYVS

SEQ ID NO: 1589 - protein, 11 aa, Artificial Sequence
  Description of Artificial Sequence: Synthetic Light chain CDR1 of Ab-31
RASQSIGNSLA

SEQ ID NO: 1590 - protein, 11 aa, Artificial Sequence
  Description of Artificial Sequence: Synthetic Light chain CDR1 of Ab-32
RASQGIGSYLA

SEQ ID NO: 1591 - protein, 11 aa, Artificial Sequence
  Description of Artificial Sequence: Synthetic Light chain CDR1 of Ab-38
SGDKLGNKYAY

SEQ ID NO: 1592 - protein, 13 aa, Artificial Sequence
  Description of Artificial Sequence: Synthetic Light chain CDR1 of Ab-42
TRSSGSIDSNYVQ

SEQ ID NO: 1593 - protein, 13 aa, Artificial Sequence
  Description of Artificial Sequence: Synthetic Light chain CDR1 of Ab-46
TRSSGNIGTNYVQ

SEQ ID NO: 1594 - protein, 11 aa, Artificial Sequence
  Description of Artificial Sequence: Synthetic Light chain CDR1 of Ab-50
GGNNIGSKGVH

SEQ ID NO: 1595 - protein, 13 aa, Artificial Sequence
  Description of Artificial Sequence: Synthetic Light chain CDR1 of Ab-52
TRSSGSIASNYVQ

SEQ ID NO: 1596 - protein, 13 aa, Artificial Sequence
  Description of Artificial Sequence: Synthetic Light chain CDR1 of Ab-55
TRSSGSIASNYVQ

SEQ ID NO: 1597 - protein, 13 aa, Artificial Sequence
  Description of Artificial Sequence: Synthetic Light chain CDR1 of Ab-56
TRSSGSIASHYVQ

SEQ ID NO: 1598 - protein, 14 aa, Artificial Sequence
  Description of Artificial Sequence: Synthetic Light chain CDR1 of Ab-65
TLRSGLNVGSYRIY

SEQ ID NO: 1599 - protein, 7 aa, Artificial Sequence
  Description of Artificial Sequence: Synthetic Light chain CDR2 of consensus, Ab-14, Ab-42, Ab-52, Ab-55
EDNQRPS

SEQ ID NO: 1600 - protein, 7 aa, Artificial Sequence
  Description of Artificial Sequence: Synthetic Light chain CDR2 of Ab-16
GKNNRPS

SEQ ID NO: 1601 - protein, 7 aa, Artificial Sequence
  Description of Artificial Sequence: Synthetic Light chain CDR2 of Ab-22
SDRDRPS

SEQ ID NO: 1602 - protein, 7 aa, Artificial Sequence
  Description of Artificial Sequence: Synthetic Light chain CDR2 of Ab-30
DVSNRPS

SEQ ID NO: 1603 - protein, 7 aa, Artificial Sequence
  Description of Artificial Sequence: Synthetic Light chain CDR2 of Ab-31
GASSRAT

SEQ ID NO: 1604 - protein, 7 aa, Artificial Sequence
  Description of Artificial Sequence: Synthetic Light chain CDR2 of Ab-32
AASTLQS

SEQ ID NO: 1605 - protein, 7 aa, Artificial Sequence
  Description of Artificial Sequence: Synthetic Light chain CDR2 of Ab-38
QDIKRPS

SEQ ID NO: 1606 - protein, 7 aa, Artificial Sequence
  Description of Artificial Sequence: Synthetic Light chain CDR2 of Ab-46
EDYRRPS

SEQ ID NO: 1607 - protein, 7 aa, Artificial Sequence
  Description of Artificial Sequence: Synthetic Light chain CDR2 of Ab-50
DDSDRPS

SEQ ID NO: 1608 - protein, 7 aa, Artificial Sequence
  Description of Artificial Sequence: Synthetic Light chain CDR2 of Ab-56
EDNKRPS

SEQ ID NO: 1609 - protein, 11 aa, Artificial Sequence
  Description of Artificial Sequence: Synthetic Light chain CDR2 of Ab-65
YKSDSNKQQAS

SEQ ID NO: 1610 - protein, 9 aa, Artificial Sequence
  Description of Artificial Sequence: Synthetic Light chain CDR3 consensus
QSYDSSTWV

SEQ ID NO: 1611 - protein, 10 aa, Artificial Sequence
  Description of Artificial Sequence: Synthetic Light chain CDR3 of Ab-14
QSYDSSNLWV

SEQ ID NO: 1612 - protein, 11 aa, Artificial Sequence
  Description of Artificial Sequence: Synthetic Light chain CDR3 of Ab-16
NSRDSSGNHYV

SEQ ID NO: 1613 - protein, 11 aa, Artificial Sequence
  Description of Artificial Sequence: Synthetic Light chain CDR3 of Ab-22
QVWDNNSDHYV

SEQ ID NO: 1614 - protein, 9 aa, Artificial Sequence
  Description of Artificial Sequence: Synthetic Light chain CDR3 of Ab-30
SSYTSSTLP

SEQ ID NO: 1615 - protein, 9 aa, Artificial Sequence
  Description of Artificial Sequence: Synthetic Light chain CDR3 of Ab-31
QQHTIPTFS

SEQ ID NO: 1616 - protein, 9 aa, Artificial Sequence
  Description of Artificial Sequence: Synthetic Light chain CDR3 of Ab-32
QQLNNYPIT

SEQ ID NO: 1617 - protein, 8 aa, Artificial Sequence
  Description of Artificial Sequence: Synthetic Light chain CDR3 of Ab-38
QTWDNSVV

SEQ ID NO: 1618 - protein, 11 aa, Artificial Sequence
  Description of Artificial Sequence: Synthetic Light chain CDR3 of Ab-42
QSYDSNNRHVI

SEQ ID NO: 1619 - protein, 9 aa, Artificial Sequence
  Description of Artificial Sequence: Synthetic Light chain CDR3 of Ab-46
QSYHSSGWE

SEQ ID NO: 1620 - protein, 11 aa, Artificial Sequence
  Description of Artificial Sequence: Synthetic Light chain CDR3 of Ab-50
QVWDSSSDHWV

SEQ ID NO: 1621 - protein, 10 aa, Artificial Sequence
  Description of Artificial Sequence: Synthetic Light chain CDR3 of Ab-52
QSYDSTTPSV

SEQ ID NO: 1622 - protein, 9 aa, Artificial Sequence
  Description of Artificial Sequence: Synthetic Light chain CDR3 of Ab-55
QSYDGITVI

SEQ ID NO: 1623 - protein, 10 aa, Artificial Sequence
  Description of Artificial Sequence: Synthetic Light chain CDR3 of Ab-56
QSYDSSNRWV

SEQ ID NO: 1624 - protein, 9 aa, Artificial Sequence
  Description of Artificial Sequence: Synthetic Light chain CDR3 of Ab-65
MIWYSSAVV

SEQ ID NO: 1625 - DNA, 717 bp, Homo sapiens
gaggtgcagctggtgcagtctgggggaggcgtggtccagcctgggaagtccctgagactctcctgtgcagcctctggattcgccttcagtagttatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagggacaggagctactaccttgactactggggccagggaaccctggtcaccgtctcctcaggtggcggcggttccggaggtggtggttctggcggtggtggcagcgaaacgacactcacgcagtctccagccaccctgtctttgtctccaggggaaagggccaccctctcctgcagggccagtcagagtgttaggagcaacttagcctggtaccagcagaaacctggccaggctcccaggcccctcatctatgatgcatccaccagggccactggcatcccagacaggttcagtggcagtgggtctgggacagacttcactctcaccatcagcagactggagcctgaagattttgcagtttattactgtcagcagcgtagcaactggcctccgacgttcggccaagggaccaaggtggaagtcaaa

SEQ ID NO: 1626 - DNA, 351 bp, Homo sapiens
gaggtgcagctggtgcagtctgggggaggcgtggtccagcctgggaagtccctgagactctcctgtgcagcctctggattcgccttcagtagttatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagggacaggagctactaccttgactactggggccagggaaccctggtcaccgtctcctca

SEQ ID NO: 1627 - DNA, 987 bp, Homo sapiens
gctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaccaaggtggacaagaaagcagagcccaaatcttgtgacaaaactcacacatccccaccgtgcccagcacctgaactcctggggggaccgtcagtcttcctcttccccccaaaacccaaggacaccctcaggatctcccggacccctgaggtcacatgcgtggtggtggacgtgagccacgaagaccctgaggtcaagttcaactggtacgtggacggcgtggaggtgcataatgccaagacaaagccgcgggaggagcagtacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 1628 - DNA, 318 bp, Homo sapiens
acgacactcacgcagtctccagccaccctgtctttgtctccaggggaaagggccaccctctcctgcagggccagtcagagtgttaggagcaacttagcctggtaccagcagaaacctggccaggctcccaggcccctcatctatgatgcatccaccagggccactggcatcccagacaggttcagtggcagtgggtctgggacagacttcactctcaccatcagcagactggagcctgaagattttgcagtttattactgtcagcagcgtagcaactggcctccgacgttcggccaagggaccaaggtggaagtcaaa

SEQ ID NO: 1629 - DNA, 348 bp, Homo sapiens
gatggtaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 1630 - protein, 102 aa, Homo sapiens
QVQLVQSGGGVPGSLRLSCAASGFTFSSYMSWVRQAPGKGLEWVISGSYYADSVKGRFTISRDNSKNTLYLQMNSLRAEDTAVYYCARDDYWGQGTLVTVSS

SEQ ID NO: 1631 - protein, 116 aa, Homo sapiens
QVQLVQSGGGVVQPGRSLRLSCAASGFTVSSNYMSWVRQAPGKGLEWVSVIYSGGSTYYADSVKGRFTISRDNSKNTLYLQMNSLRAEDTAVYYCAKDYGEGFDYWGQGTLVTVSS

SEQ ID NO: 1632 - protein, 117 aa, Homo sapiens
EVQLVQSGGGLVKPGGSLRLSCAASGFTFSDYYMSWIRQAPGKGLEWVSYISSSGSTIYYADSVKGRFTISRDNAKNSLYLQMNSLRAEDTGVYYCARDWGYSFGDWGQGTLVTVSS

SEQ ID NO: 1633 - protein, 127 aa, Homo sapiens
QVQLVQSGAEVKKPGASVKVSCKASGYTFTTYGISWVRQAPGQGLEWMGWISAYNGNTNYAQKLQGRVTMTTDTSTSTAYMELRSLRSDDTAVYYCARVGYYGDYAWGYYYYGMDVWGQGTLVTVSS

SEQ ID NO: 1634 - protein, 122 aa, Homo sapiens
QVQLQESGGGLVKPGGSLRLSCAASGFTFSDYYMSWIRQAPGKGLEWVSYISSSGSTIYYADSVKGRFTISRDNAKNSLYLQMNSLRAEDTAVYYCARERWLQIGEDAFDIWGQGTTVTVSS

SEQ ID NO: 1635 - protein, 116 aa, Homo sapiens
QVQLVQSGGGLIQPGGSLRLSCAASGFTVSSNYMSWVRQAPGKGLEWVSVIYSGGSTYYADSVKGRFTISRDNSKNTLYLQMNSLRAEDTAVYYCARNFGEDFDYWGQGTLVTVSS

SEQ ID NO: 1636 - protein, 117 aa, Homo sapiens
EVQLVQSGGGVVQPGKSLRLSCAASGFAFSSYAMHWVRQAPGKGLEWVAVISYDGSNKYYADSVKGRFTISRDNSKNTLYLQMNSLRAEDTAVYYCARDRSYYLDYWGQGTLVTVSS

SEQ ID NO: 1637 - protein, 124 aa, Homo sapiens
QVQLVQSGGGLVQPGGSLRLSCAASGFTFSSSWMSWVRQAPGKGLEWVAYIKQDGSEKYYVDSVKGRFTISRDNAKNSLYLQMDSLRAEDTAVYYCARDQGWGWDGTEYYSDYWGQGTLVTVSS

SEQ ID NO: 1638 - protein, 123 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDDLSDYGEWLGPDYWGQGTLVTVSS

SEQ ID NO: 1639 - protein, 81 aa, Homo sapiens
QLTQPSSGSPGQRTISCGSSGNVSWYQQPGAPKLLIYRPSGVPDRFSGSKSGTASLTISGLQEDEADYYCVFGGTKLTVLG

SEQ ID NO: 1640 - protein, 106 aa, Homo sapiens
IQMTQSPSSLSASVGDRVTITCRATQSISTHLNWYQQRGGKAPKLLIYGASTLESGVPSRFSGSGSGTEFTLTISSLQPEDFATYYCLQHRSYPWTFGQGTNVEIK

SEQ ID NO: 1641 - protein, 112 aa, Homo sapiens
SYELTQPPSASGTPGQRVTISCSGSSSSIGSETVNWYQQLPGTAPKLLIYSNNQRPSGVPDRFSGSKSGTSASLAISGLQSEDEADYYCTAWDDTLNGRVIFGGGTKLTVLG

SEQ ID NO: 1642 - protein, 111 aa, Homo sapiens
QTVVTQEPSFSVSPGGTITLTCDLNSGLVSSSHYPSWYQQTPGQAPRTLIYNTNIRSSGVPDRFSGAILGNKAALTITGAQAEDESDYYCVLYMGSGISVFGGGTKLTVLG

SEQ ID NO: 1643 - protein, 111 aa, Homo sapiens
QSALTQPASVSGSPGQSITISCTGTSSDLGGHNFVSWYQQHPGKAPKLMIYDVFNRPSGVSSRFSGSKSGNTASLTISGLQAEDEADYFCSSYTITNIVVFGRGTKLTVLG

SEQ ID NO: 1644 - protein, 106 aa, Homo sapiens
TTLTQSPATLSLSPGERATLSCRASQSVRSNLAWYQQKPGQAPRPLIYDASTRATGIPDRFSGSGSGTDFTLTISRLEPEDFAVYYCQQRSNWPPTFGQGTKVEVK

SEQ ID NO: 1645 - protein, 111 aa, Homo sapiens
QSALTQPASVSGSPGQSITISCTGTSSDVGGYNYVSWYQQHPGKAPKLMIYDVSKRPSGVPDRFSGSKSGNTASLTISGLQAEDEADYFCSSYTITDIVVFGGGTKLTVLR

SEQ ID NO: 1646 - protein, 111 aa, Homo sapiens
QPGLTQPPSASGTPGQRVTISCSGSRSNIGGNTVNWYQHVPGTAPKLLIYSNNQRPSGVPDRFSGSKSGTSASLAISGLRSEDEAEYYCATWEDSLSGYVFGPGTKVTVLG

SEQ ID NO: 1647 - protein, 15 aa, Homo sapiens
RTMHPSDEFLPLGMP

SEQ ID NO: 1648 - protein, 15 aa, Homo sapiens
VVPLGRCVSHPAICA

SEQ ID NO: 1649 - protein, 15 aa, Homo sapiens
SVDDCRWNLNCEPPP

SEQ ID NO: 1650 - protein, 13 aa, Homo sapiens
CLSATCDCTLCGP

SEQ ID NO: 1651 - protein, 15 aa, Homo sapiens
GTGLVPLFDPRYRFL

SEQ ID NO: 1652 - protein, 15 aa, Homo sapiens
PNCWVGLTGAHSCFL

SEQ ID NO: 1653 - protein, 14 aa, Homo sapiens
YQADCLMNRCPTAE

SEQ ID NO: 1654 - protein, 669 aa, Homo sapiens
MFIFLLFLTLTSGSDLDRCTTFDDVQAPNYTQHTSSMRGVYYPDEIFRSDTLYLTQDLFLPFYSNVTGFHTINHTFGNPVIPFKDGIYFAATEKSNVVRGWVFGSTMNNKSQSVIIINNSTNVVIRACNFELCDNPFFAVSKPMGTQTHTMIFDNAFNCTFEYISDAFSLDVSEKSGNFKHLREFVFKNKDGFLYVYKGYQPIDVVRDLPSGFNTLKPIFKLPLGINITNFRAILTAFSPAQDIWGTSAAAYFVGYLKPTTFMLKYDENGTITDAVDCSQNPLAELKCSVKSFEIDKGIYQTSNFRVVPSGDVVRFPNITNLCPFGEVFNPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTPSSKRFQPFQQFGRDVSDFTDSVRDPKTSEILDISPCAFGGVSVITPGTNASSEVAVLYQDVNCTDVSTAIHADQLTPAWRIYSTGNNVFQTQAGCLIGAEHVDTSYECDIPIGAGICASYHTVSLLRSTSQKS

SEQ ID NO: 1655 - protein, 20 aa, Homo sapiens
RVVVLSFELGPPGGPFGEVF

SEQ ID NO: 1656 - protein, 14 aa, Homo sapiens
VVVSFELNLCPFGE

SEQ ID NO: 1657 - protein, 11 aa, Homo sapiens
  MOD_RES (5)..(7): Any amino acid
SFELXXXPFGE

SEQ ID NO: 1658 - protein, 13 aa, Homo sapiens
  MOD_RES (5)..(9): Any amino acid
SFELXXXXXPFGE

SEQ ID NO: 1659 - protein, 5 aa, Homo sapiens
VYDNK

SEQ ID NO: 1660 - protein, 5 aa, Homo sapiens
RSYYL

SEQ ID NO: 1661 - protein, 10 aa, Homo sapiens
RASQVRSNLA

SEQ ID NO: 1662 - protein, 6 aa, Homo sapiens
DASTAT

SEQ ID NO: 1663 - protein, 9 aa, Homo sapiens
QQRSNWPPT

SEQ ID NO: 1664 - protein, 13 aa, Homo sapiens
CLSATCDCTLCGP

SEQ ID NO: 1665 - DNA, 390 bp, Artificial Sequence; identical to SEQ ID NO: 1471
  Description of Artificial Sequence: Synthetic polynucleotide

SEQ ID NO: 1666 - protein, 130 aa, Artificial Sequence; identical to SEQ ID NO: 1472
  Description of Artificial Sequence: Synthetic polypeptide

SEQ ID NO: 1667 - DNA, 330 bp, Artificial Sequence
  Description of Artificial Sequence: Synthetic polynucleotide
aattttatgctgactcagccaccctcagcgtctgggacccccgggcagagggtcaccatctcttgctctggaagcagctccaacatcggaggtaatactgtacactggttccagcagctcccaggaacggcccccaaactcctcatctatactaatagtctgcggccctcaggggtccctgaccgattctctggctccaagtctggcacctcagcctccctggccatcagtgggctccagtctgaggatgaggctgattattactgtgcagcatgggatgacagcctaaatggtcaggtgttcggcggagggaccaagctgaccgtccta

SEQ ID NO: 1668 - protein, 110 aa, Artificial Sequence; identical to SEQ ID NO: 1473
  Description of Artificial Sequence: Synthetic polypeptide

SEQ ID NO: 1669 - DNA, 330 bp, Artificial Sequence; identical to SEQ ID NO: 1474
  Description of Artificial Sequence: Synthetic polynucleotide

SEQ ID NO: 1670 - protein, 110 aa, Artificial Sequence; identical to SEQ ID NO: 1475
  Description of Artificial Sequence: Synthetic polypeptide

SEQ ID NO: 1671 - protein, 8 aa, Artificial Sequence
  Description of Artificial Sequence: Synthetic peptide
GFTFSNYG

SEQ ID NO: 1672 - protein, 8 aa, Artificial Sequence
  Description of Artificial Sequence: Synthetic peptide
ISFDGSKK

SEQ ID NO: 1673 - protein, 25 aa, Artificial Sequence
  Description of Artificial Sequence: Synthetic peptide
CAKLPSPYYFDSRFVWVAASAFHFW

SEQ ID NO: 1674 - protein, 8 aa, Artificial Sequence
  Description of Artificial Sequence: Synthetic peptide
SSNIGGNT

SEQ ID NO: 1675 - protein, 3 aa, Artificial Sequence
  Description of Artificial Sequence: Synthetic peptide
TNS

SEQ ID NO: 1676 - protein, 13 aa, Artificial Sequence [sequence omitted]

SEQ ID NO: 1677 - protein, 13 aa, Artificial Sequence
  Description of Artificial Sequence: Synthetic peptide
CAAWDNSLNGQVF

SEQ ID NO: 1678 - protein, 9 aa, Artificial Sequence
  Description of Artificial Sequence: Synthetic peptide
TETSQVAPA

SEQ ID NO: 1679 - DNA, 28 bp, Artificial Sequence
  Description of Artificial Sequence: Synthetic oligonucleotide
tcgacgcgtgaggtgcagctggtgcagt

SEQ ID NO: 1680 - DNA, 29 bp, Artificial Sequence
  Description of Artificial Sequence: Synthetic oligonucleotide
tcctctagacaggacggtgaccttggtcc

SEQ ID NO: 1681 - DNA, 81 bp, Artificial Sequence
  Description of Artificial Sequence: Synthetic primer
tagggcgcggccgcaaccgagaccagccaggtggcgcccgccgggggaggaggcagccccaccacgacgccagcgccgcga

SEQ ID NO: 1682 - DNA, 81 bp, Artificial Sequence
  Description of Artificial Sequence: Synthetic primer
tagggcgcggccgcaaccgagaccagccaggtggcgcccgccggcggaggaggcagcattgaagttatgtatcctcctcct

SEQ ID NO: 1683 - DNA, 41 bp, Artificial Sequence
  Description of Artificial Sequence: Synthetic primer
ctagccttaattaattagcgaggagggggcagggcctgcat

SEQ ID NO: 1684 - protein, 5 aa, Artificial Sequence
  Description of Artificial Sequence: Synthetic peptide
GGGGS

SEQ ID NO: 1685 - protein, 14 aa, Artificial Sequence
  Description of Artificial Sequence: Synthetic peptide
TETSQVQPQGGGGS

SEQ ID NO: 1686 - protein, 9 aa, Artificial Sequence
  Description of Artificial Sequence: Synthetic peptide
TETSQVQPQ

What is claimed is:

1. A nucleic acid encoding a chimeric antigen receptor (CAR) comprising an extracellular domain, a transmembrane domain, and an intracellular signaling domain, wherein a CD28 costimulatory domain is positioned between the transmembrane domain and the intracellular signaling domain; wherein the intracellular signaling domain comprises a CD3z primary signaling domain; and wherein the extracellular domain comprises an anti-carbonic anhydrase IX (anti-CAIX) scFv comprising a $V_H$ amino acid sequence according to SEQ ID NO: 847 and a $V_L$ amino acid sequence according to SEQ ID NO: 868, further comprising a nucleic acid encoding an anti-PDL1 IgG4 scFv-Fc or an anti-PDL1 IgG1 scFv-Fc positioned after the intracellular signaling domain.

2. A vector comprising the nucleic acid of claim 1.

3. A cell comprising the vector of claim 2.

4. The cell of claim 3, wherein the cell is a T-cell or an NK cell.

5. The cell of claim 4, wherein the T cell is $CD4^+$ or $CD8^+$.

6. The nucleic acid of claim 1, wherein the chimeric antigen receptor further comprises a stalk region positioned between the extracellular domain and the transmembrane domain.

7. The nucleic acid of claim 1, wherein the transmembrane domain comprises a CD28 transmembrane domain.

8. A genetically engineered cell which expresses and bears on the cell surface membrane a chimeric antigen receptor comprising an extracellular domain, a transmembrane domain, and an intracellular signaling domain, wherein a CD28 costimulatory domain is positioned between the transmembrane domain and the intracellular signaling domain; wherein the intracellular signaling domain comprises a CD3z primary signaling domain; and wherein the extracellular domain comprises an anti-carbonic anhydrase IX (anti-CAIX) scFv comprising a $V_H$ amino acid sequence according to SEQ ID NO: 847 and a $V_L$ amino acid sequence according to SEQ ID NO: 868, wherein the cell is further engineered to express and secrete an anti-PDL1 IgG4 scFv-Fc or an anti-PDL1 IgG1 scFv-Fc.

9. The genetically engineered cell of claim 8, wherein the cell is a T-cell or an NK cell.

10. The genetically engineered cell of claim 9, wherein the T cell is $CD4^+$ or $CD8^+$.

11. The genetically engineered cell of claim 8, wherein the chimeric antigen receptor further comprises a stalk region positioned between the extracellular domain and the transmembrane domain.

12. The genetically engineered cell of claim 8, wherein the transmembrane domain comprises a CD28 transmembrane domain.

* * * * *